United States Patent 7,745,391 (HUMAN THROMBOSPONDIN POLYPEPTIDE) - sequence listing, part 90

SEQ ID NO: 297899 - DNA, 1716 bp, Homo sapiens
gggcgcgcaaggggcgagtctgtccagccggcagcaccccaggccggatggacgcttgttcctggttctgtgccccgtgagcgctcaacgccctgcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatcttattattgctctcggaatccagctggactatgagaagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaagacagggaagcgatccaaggccaatatcattttcaacacttctcttggagccattttcggggttaagaagtatgcagatgccctgcaggagatcatccaggagcggaacctcactgttaactacaagaaaaacctcattgaagtccgagccgataaacaagaggctgtatttgagaacctggacaaaccaggagagacccaagtgatttcatatgaaatgcttcatgtcacacctccaatgagcccaccagatgtcctcaagaccagtcctgtggctgatgctgctggttgggtggatgtggataaagaaactctgcaacacaggaggtacccaaatgtgtttgggattggggactgcaccaaccttcctacgtcaaagaccgctgctgcagtagctgcccagtcaggaatacttgataggacaatttctgtaattatgaagaatcaaacaccaacaaagaagtatgatggctacacatcatgtccactggtgaccggctacaaccgtgtgattcttgctgagtttgactacaaagcagagccgctagaaaccttcccctttgatcaaagcaaagagcgcctttccatgtatctcatgaaagctgacctgatgcctttcctgtattggaatatgatgctaaggggttactggggaggaccagcgtttctgcgcaagttgtttcatctaggtatgagttaaggatggctcagcacttgctcatcttggatggcttctgggccaaaactgcagtcactgaatgaccaagagcagcacgaaggacttggaacctatccttgtaaagagttccttgatgggtaatggtgaccaaatgcctcccttttcagtacctttgaacagcaaccatgtgggctactcatgatgggcttgattctttgggaataataaaatgaaataatacttttattttctgaataaaagtttgtcactga

SEQ ID NO: 297900 - DNA, 2410 bp, Homo sapiens
  misc_feature (2201)..(2201): n is a, c, g, or t
  misc_feature (2250)..(2250): n is a, c, g, or t
  misc_feature (2275)..(2275): n is a, c, g, or t
gcctccgcccggatggcaggcgggcggggccccagtccaggccttgagacccagaagggagcgaaggtttttgctgcgccaacgcagtgaccgaaggctccgctcacgcccggcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatcttattattgctctcggaatccagctggactatgagaagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaagacagggaagcgatccaaggccaatatcattttcaacacttctcttggagccattttcggggttaagaagtatgcagatgccctgcaggagatcatccaggagcggaacctcactgttaactacaagaaaaacctcattgaagtccgagccgataaacaagaggctgtatttgagaacctggacaaaccaggagagacccaagtgatttcatatgaaatgcttcatgtcacacctccaatgagcccaccagatgtcctcaagaccagtcctgtggctgatgctgctggttgggtggatgtggataaagaaactctgcaacacaggaggtacccaaatgtgtttgggattggggactgcaccaaccttcctacgtcaaagaccgctgctgcagtagctgcccagtcaggaatacttgataggacaatttctgtaattatgaagaatcaaacaccaacaaagaagtatgatggctacacatcatgtccactggtgaccggctacaaccgtgtgattcttgctgagtttgactacaaagcagagccgctagaaaccttcccctttgatcaaagcaaagagcgcctttccatgtatctcatgaaagctgacctgatgcctttcctgtattggaatatgatgctaaggggttactggggaggaccagcgtttctgcgcaagttgtttcatctaggtatgagttaaggatggctcagcacttgctcatcttggatggcttctgggccaaaactgcagtcactgaatgaccaagagcagcacgaaggacttggaacctatccttgtaaagagttccttgatgggtaatggtgaccaaatgcctcccttttcagtacctttgaacagcaaccatgtgggctactcatgatgggcttgattctttgggaataataaaatgaaataatacttttaaaaaaaaaaaaagaaaaaaaaaaaaaaacaaaaaaaaaacaaaaaaaaaaaaaaacaaacgactacaaaacaaaacaaacaaaaaaacaaaaaaaagcatgtaggggcggggcgcgacgcgcgcgcccagaccaatagaatcagtctattcacacccaccaactctggtgtgggtgcagcgcgggagcgcgccacaaatgtgtgaagcaagcagcgagtgtgacacacacagtgtggtccccaaagagacaacctcgccgtcccgcaacgcgaatcggcgggagcgtggggtcgttcccctccccctacaaaaaaaaaaaaaacagcgcgcgcgcggggagagagacaaccacagactaacgtgtgtggttagagagacaaaacacaaacgtagaagtaacgtagggtggtagatctgaggcagagcatcactaggctgggtgttaggctatatatacccaacaagaaggacggagaacagatctcacaaggngacgaagacagcgtcgcagactaataacaataatagactcgcgctcccngccgatgcggagtgtgagttcaacnactatacacgataagaacgaataagaactacacagacggtcaacacagaatacagtagcagaacagaactgaggcatacggacataagcgaacacgaaccacaaacaacatcgaaaagaactagaaagacacaca

SEQ ID NO: 297901 - DNA, 1747 bp, Homo sapiens
agggagttttcccatgttccaggaggcagccagcttgtaactagcaagcattgctatgtttgtatttctgatacattttctaaaagagatcgcagaacaaagggtcctgactcaccaaggatacagcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatcttattattgctctcggaatccagctggactatgagaagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaagacagggaagcgatccaaggccaatatcattttcaacacttctcttggagccattttcggggttaagaagtatgcagatgccctgcaggagatcatccaggagcggaacctcactgttaactacaagaaaaacctcattgaagtccgagccgataaacaagaggctgtatttgagaacctggacaaaccaggagagacccaagtgatttcatatgaaatgcttcatgtcacacctccaatgagcccaccagatgtcctcaagaccagtcctgtggctgatgctgctggttgggtggatgtggataaagaaactctgcaacacaggaggtacccaaatgtgtttgggattggggactgcaccaaccttcctacgtcaaagaccgctgctgcagtagctgcccagtcaggaatacttgataggacaatttctgtaattatgaagaatcaaacaccaacaaagaagtatgatggctacacatcatgtccactggtgaccggctacaaccgtgtgattcttgctgagtttgactacaaagcagagccgctagaaaccttcccctttgatcaaagcaaagagcgcctttccatgtatctcatgaaagctgacctgatgcctttcctgtattggaatatgatgctaaggggttactggggaggaccagcgtttctgcgcaagttgtttcatctaggtatgagttaaggatggctcagcacttgctcatcttggatggcttctgggccaaaactgcagtcactgaatgaccaagagcagcacgaaggacttggaacctatccttgtaaagagttccttgatgggtaatggtgaccaaatgcctcccttttcagtacctttgaacagcaaccatgtgggctactcatgatgggcttgattctttgggaataataaaatgaaataatacttttattttctgaataaaagtttgtcactga

SEQ ID NO: 297902 - DNA, 1762 bp, Homo sapiens
gcctccgcccggatggcaggcgggcggggccccagtccaggccttgagacccagaagggagcgaaggtttttgctgcgccaacgcagtgaccgaaggctccgctcacgcccggcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatcttattattgctctcggaatccagctggactatgagaagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaagacagggaagcgatccaaggccaatatcattttcaacacttctcttggagccattttcggggttaagaagtatgcagatgccctgcaggagatcatccaggagcggaacctcactgttaactacaagaaaaacctcattgaagtccgagccgataaacaagaggctgtatttgagaacctggacaaaccaggagagacccaagtgatttcatatgaaatgcttcatgtcacacctccaatgagcccaccagatgtcctcaagaccagtcctgtggctgatgctgctggttgggtggatgtggataaagaaactctgcaacacaggaggtacccaaatgtgtttgggattggggactgcaccaaccttcctacgtcaaagaccgctgctgcagtagctgcccagtcaggaatacttgataggacaatttctgtaattatgaagaatcaaacaccaacaaagaagtatgatggctacacatcatgtccactggtgaccggctacaaccgtgtgattcttgctgagtttgactacaaagcagagccgctagaaaccttcccctttgatcaaagcaaagagcgcctttccatgtatctcatgaaagctgacctgatgcctttcctgtattggaatatgatgctaaggtacatttttttgtgttatttcttacaggggttactggggaggaccagcgtttctgcgcaagttgtttcatctaggtatgagttaaggatggctcagcacttgctcatcttggatggcttctgggccaaaactgcagtcactgaatgaccaagagcagcacgaaggacttggaacctatccttgtaaagagttccttgatgggtaatggtgaccaaatgcctcccttttcagtacctttgaacagcaaccatgtgggctactcatgatgggcttgattctttgggaataataaaatgaaataatacttttattttctgaataaaagtttgtcactga

SEQ ID NO: 297903 - DNA, 734 bp, Homo sapiens
atactgtcagcgttgctactgtcaggtggtgctgctgtcatggtggtgctgctgtctggtgatgctgctggttgggtggatgtggataaagaaactctgcaacacaggaggtacccaaatgtgtttgggattggggactgcaccaaccttcctacgtcaaagaccgctgctgcagtagctgcccagtcaggaatacttgataggacaatttctgtaattatgaagaatcaaacaccaacaaagaagtatgatggctacacatcatgtccactggtgaccggctacaaccgtgtgattcttgctgagtttgactacaaagcagagccgctagaaaccttcccctttgatcaaagcaaagagcgcctttccatgtatctcatgaaagctgacctgatgcctttcctgtattggaatatgatgctaaggggttactggggaggaccagcgtttctgcgcaagttgtttcatctaggtatgagttaaggatggctcagcacttgctcatcttggatggcttctgggccaaaactgcagtcactgaatgaccaagagcagcacgaaggacttggaacctatccttgtaaagagttccttgatgggtaatggtgaccaaatgcctcccttttcagtacctttgaacagcaaccatgtgggctactcatgatgggcttgattctttgggaataataaaatgaaataatacttttattttctgaataaaagtttgtcactga

SEQ ID NO: 297904 - DNA, 1006 bp, Homo sapiens
gcctccgcccggatggcaggcgggcggggccccagtccaggccttgagacccagaagggagcgaaggtttttgctgcgccaacgcagtgaccgaaggctccgctcacgcccggcctgatcctgcctgaagatggtgccactggtggctgtggtatcagggccccgtgcccagctctttgcctgcctgctcaggctgggcactcagcaggtcggcccccttcagctgcacaccggggccagccatgcggccaggaaccattatgaggtgctggtgctgggtgggggcagtggcggaatcaccatggctgcccgcatgaagaggaaagtgggtgcagagaatgtggccattgttgagcccagtgagagacatttctaccagccaatctggacactggtgggtgctggtgccaaacaattgtcctcatctggtcgtcccacggcaagtgtgattccatctggtgtagaatggatcaaagctagagtgactgagttgaacccagacaagaactgcattcacacagatgacgacgagaagatctcctaccgatatcttattattgctctcggaatccagctggactatgagaagattaaaggcctacctgaaggtttcgctcatcccaaaatagggtcgaattattcagttaagactgtagagaagacatggaaagctctgcaggacttcaaagagggcaatgccatcttcaccttcccaaatactccagtgaagtgtgctggagcccctcagaagatcatgtacttatcagaagcctacttcaggaaggtatgcttcctttctggggacagagatgagcagggcggacagtgctaattcactgattgcaagaattccattttatctctattgtaatcccttttttatctcggaatttttattacatgtgtacaaaattagttaactggaagtttataaaatataaaagaggagaaaatcactcatgatccaattgctttaataaagctgcagttttcaatttgacatggc

SEQ ID NO: 297905 - DNA, 3884 bp, Homo sapiens
agcggtgggtgtggaaaaagtatgtcggcaagtcagctggtttcccagtgcaggacgcgctgacagctcgagtgagcggactgcccaggacttcggaactagacgagttctgtagaaatcctgtcaaagaatatgaagaaaaacagagaaagattctgcaatagagagagagaatttgtatataaatttaaagtaggaagtcagtgcttagaactgagagtgccactcaaatttcctgttcaagagaatgccagtcatttgcatggacgtctgatgctgctgcacagtttaccgtgctttatagaaaaagacttaaaagaagctctgactcagtttatagaagaagaatccctcagcgattatgatagagatgctgaagcatccctggcagctgtgaaatcaggtgaagtagatttacatcagctggcgagtacatgggccaaagcttatgctgagaccacgttagagcatgcaaggcctgaagaacccagctgggatgaagattttgcagatgtgtaccatgacttaattcattctcctgcctctgaaactctcttaaatttggaacataattactttgttagtatctcagaactgattggtgaaagagatgtggagctgaaaaaattacgagagagacaaggtattgaaatggaaaaagtcatgcaggaattgggaaaatcactgacagatcaagatgtaaattcactggctgctcagcattttgaatcccagcaagacctagaaaataaatggtcgaatgaattaaaacaatcaactgccatccaaaaacaagagtatcaagaatgggtaataaaacttcaccaagacctaaaaaaccccaacaacagctcccttagtgaggaaattaaagttcagccaagtcagttcagagaatctgtagaagcaattggaaggatttatgaggaacagagaaagttagaagaaagttttaccattcacttaggagcccagttgaagaccatgcataatttgagattgctgagagcagatatgctggacttctgtaagcataaaagaaatcatcgaagtggtgtgaaacttcatcggctccaaacagctctgtcactttattctacatctctctgtggcctggttttactagtagataatcgaattaattcatatagtggtattaaaagagattttgccacagtttgccaagaatgcactgacttccatttcccccgaattgaagagcaattagaagttgtccaacaggtggtactttatgctagaacccagcgcaggagtaaattgaaagaatcacttgattctggaaaccaaaatggaggaaatgatgataagactaagaatgctgagaggaactatttaaatgttttacctggggaattttatattacacggcattctaatctctcagaaatccatgttgctttccatctctgtgtggatgaccatgtgaaatcgggaaacatcactgctcgtgatcctgccattatgggactccgaaatatactcaaagtttgctgtacccatgacatcacaacaataagcattcctctcttgctggtacatgatatgtcagaggaaatgactataccctggtgcttaaggagagcggaacttgtgttcaagtgtgtcaaaggtttcatgatggaaatggcttcatgggatggaggaatttctaggacagtgcaatttctagtaccacagagtatttctgaagaaatgttttatcaacttagtaacatgcttccccagatcttccgagtatcatcaacactcactctgacatccaagcactaaacccttatagattgacatgctggcagaagatgattgttaaactctccaggaacttgtgctatgctgggaatctgtcaagcaaaagatgcccagaaagagaacttgcagctcaatccacaaatcaagatacatgtgtgtgaaaccattccaaaaatttatatactgcacaaactggtgatcaacccctaacttaaacacttaaagtctctttatgaatttctctttttttcttctctgtgttacctgtgaatattagtaatctaaaactttttatttatcacacatggacacttgggaaaggaaacttgattatatttacatggaggcatttgactttttcaagaggcttgactcgtctcaggtgcaatccttaattaaacatacaaacaaaattttccttttactttctttgccaaaacaaaatgtaaaagcactgaaatatacattgcaagtacaaatttcctgtgaaaatctttttatagaaacacaaatgtataagacaaatgtgcttgttcttttaaattctcctgtttcagaatctctttttaatctactcctaaggatgtacaagttagagtcagaagacgttttggattttttccctctctctcatcctcccgctgtgcccttgcacttgcatattaataacatttcatggactgggaaatagtgttcttttttgcaagcttgatgtcaagttagtctaaaccagcacctggcagtattttagtgctcatcaacattgtgacaatcacacaaggaagatcatttctacatttctgtcctccctgcgttctcagcttgcttaaccattcctctacctcttgcatttttttgcggataaatgtatccccatttctgcttctctgtttcccctccttttccattgtttttccttatggtactactttctcaggtgctacatatcatatatttgtcccatctataacatatttaaatgctataagtagtaactccattaaacaaaggcatttacaaaagcacacaggtgtttagaaaagcaatagtttcatcaattccaagttatgtggatattgtaactggccacaagaatgaaatggagggcatttggtgtcataagatggcatgtcttgatgacaagaaacaaaacgcccttcattaatatgcctcagtgtaataactattatagaaactgttggcaagcagagtgctttcctataacagaatgtgtcttaattttctactcgagggaaaggtttgtccaggtaacaacactaaagacaaccctaagaacacccactccagcagtatgtccattagacactaaaactctccaaattatttgtcagggagcctggcgattctgccaagaaggcaggtgttttgcccttagagcctatacagttctcttggagaaattgtctttcaggcaccactgttaatcactgagactgattctaatgcaaagcagggaagacagaggcagaaaccaggagagtggtagatcagtgcagcccagatatcggaatggaggagcaaagtttcattcacggatgtttgttgaatgctgctgcccaactcttcctttgtcacctctaggctattccactaagttacttataaactggtggctttaactgagggctgtgtaaaggtactatttggcatgtgaagtcaggataaatttatcgaatgtccgttttccacatgcaactgtgttacagaagtagtaaaattggaagaatcatgtttatggtgttaccactgatggaaacacacaaacaccaagctaataataaatatataacttaaaaagctaattatatgcactgaaatggtgggaattttagtgatgcagtaattgaggagtctggagttttgtatttggaccaagaattatgagatgaggatctttttctgagtgttctaaagggcttcttgagggggagtggtttaaagcacttcatgaatgatgtgaagaaggtaccttgggctgagacagcattctaggtacagatggcactctgttcaaccaactgtggatggaaaatattctgaaaaaaaatacaataaaaattttaaaaatacaatataacatctgtttacatggc

SEQ ID NO: 297906 - DNA, 4056 bp, Homo sapiens
agcggtgggtgtggaaaaagtatgtcggcaagtcagctggtttcccagtgcaggacgcgctgacagctcgagtgagcggactgcccaggacttcggaactagacgagttctgtagaaatcctgtcaaagaatatgaagaaaaacagagaaagattctgcaatagagagagagaatttgtatataaatttaaagtaggaagtcagtgcttagaactgagagtgccactcaaatttcctgttcaagagaatgccagtcatttgcatggacgtctgatgctgctgcacagtttaccgtgctttatagaaaaagacttaaaagaagctctgactcagtttatagaagaagaatccctcagcgattatgatagagatgctgaagcatccctggcagctgtgaaatcaggtgaagtagatttacatcagctggcgagtacatgggccaaagcttatgctgagaccacgttagagcatgcaaggcctgaagaacccagctgggatgaagattttgcagatgtgtaccatgacttaattcattctcctgcctctgaaactctcttaaatttggaacataattactttgttagtatctcagaactgattggtgaaagagatgtggagctgaaaaaattacgagagagacaaggtattgaaatggaaaaagtcatgcaggaattgggaaaatcactgacagatcaagatgtaaattcactggctgctcagcattttgaatcccagcaagacctagaaaataaatggtcgaatgaattaaaacaatcaactgccatccaaaaacaagagtatcaagaatgggtaataaaacttcaccaagacctaaaaaaccccaacaacagctcccttagtgaggaaattaaagttcagccaagtcagttcagagaatctgtagaagcaattggaaggatttatgaggaacagagaaagttagaagaaagttttaccattcacttaggagcccagttgaagaccatgcataatttgagattgctgagagcagatatgctggacttctgtaagcataaaagaaatcatcgaagtggtgtgaaacttcatcggctccaaacagctctgtcactttattctacatctctctgtggcctggttttactagtagataatcgaattaattcatatagtggtattaaaagagattttgccacagtttgccaagaatgcactgacttccatttcccccgaattgaagagcaattagaagttgtccaacaggtggtactttatgctagaacccagcgcaggagtaaattgaaagaatcacttgattctggaaaccaaaatggaggaaatgatgataagactaagaatgctgagaggaactatttaaatgttttacctggaactacagaaaatacaagctgatgagatttttcttggcttgtagagctacacagaaaaaagagtgatggtaggaagcatggattttaatgtttgagaaagactgctccagcgttcagccttaaatactcattcattcaacaaatacttatcgagtaccttctacgtgccaggggaattttatattacacggcattctaatctctcagaaatccatgttgctttccatctctgtgtggatgaccatgtgaaatcgggaaacatcactgctcgtgatcctgccattatgggactccgaaatatactcaaagtttgctgtacccatgacatcacaacaataagcattcctctcttgctggtacatgatatgtcagaggaaatgactataccctggtgcttaaggagagcggaacttgtgttcaagtgtgtcaaaggtttcatgatggaaatggcttcatgggatggaggaatttctaggacagtgcaatttctagtaccacagagtatttctgaagaaatgttttatcaacttagtaacatgcttccccagatcttccgagtatcatcaacactcactctgacatccaagcactaaacccttatagattgacatgctggcagaagatgattgttaaactctccaggaacttgtgctatgctgggaatctgtcaagcaaaagatgcccagaaagagaacttgcagctcaatccacaaatcaagatacatgtgtgtgaaaccattccaaaaatttatatactgcacaaactggtgatcaacccctaacttaaacacttaaagtctctttatgaatttctctttttttcttctctgtgttacctgtgaatattagtaatctaaaactttttatttatcacacatggacacttgggaaaggaaacttgattatatttacatggaggcatttgactttttcaagaggcttgactcgtctcaggtgcaatccttaattaaacatacaaacaaaattttccttttactttctttgccaaaacaaaatgtaaaagcactgaaatatacattgcaagtacaaatttcctgtgaaaatctttttatagaaacacaaatgtataagacaaatgtgcttgttcttttaaattctcctgtttcagaatctctttttaatctactcctaaggatgtacaagttagagtcagaagacgttttggattttttccctctctctcatcctcccgctgtgcccttgcacttgcatattaataacatttcatggactgggaaatagtgttcttttttgcaagcttgatgtcaagttagtctaaaccagcacctggcagtattttagtgctcatcaacattgtgacaatcacacaaggaagatcatttctacatttctgtcctccctgcgttctcagcttgcttaaccattcctctacctcttgcatttttttgcggataaatgtatccccatttctgcttctctgtttcccctccttttccattgtttttccttatggtactactttctcaggtgctacatatcatatatttgtcccatctataacatatttaaatgctataagtagtaactccattaaacaaaggcatttacaaaagcacacaggtgtttagaaaagcaatagtttcatcaattccaagttatgtggatattgtaactggccacaagaatgaaatggagggcatttggtgtcataagatggcatgtcttgatgacaagaaacaaaacgcccttcattaatatgcctcagtgtaataactattatagaaactgttggcaagcagagtgctttcctataacagaatgtgtcttaattttctactcgagggaaaggtttgtccaggtaacaacactaaagacaaccctaagaacacccactccagcagtatgtccattagacactaaaactctccaaattatttgtcagggagcctggcgattctgccaagaaggcaggtgttttgcccttagagcctatacagttctcttggagaaattgtctttcaggcaccactgttaatcactgagactgattctaatgcaaagcagggaagacagaggcagaaaccaggagagtggtagatcagtgcagcccagatatcggaatggaggagcaaagtttcattcacggatgtttgttgaatgctgctgcccaactcttcctttgtcacctctaggctattccactaagttacttataaactggtggctttaactgagggctgtgtaaaggtactatttggcatgtgaagtcaggataaatttatcgaatgtccgttttccacatgcaactgtgttacagaagtagtaaaattggaagaatcatgtttatggtgttaccactgatggaaacacacaaacaccaagctaataataaatatataacttaaaaagctaattatatgcactgaaatggtgggaattttagtgatgcagtaattgaggagtctggagttttgtatttggaccaagaattatgagatgaggatctttttctgagtgttctaaagggcttcttgagggggagtggtttaaagcacttcatgaatgatgtgaagaaggtaccttgggctgagacagcattctaggtacagatggcactctgttcaaccaactgtggatggaaaatattctgaaaaaaaatacaataaaaattttaaaaatacaatataacatctgtttacatggc

SEQ ID NO: 297907 - DNA, 3569 bp, Homo sapiens
agcggtgggtgtggaaaaagtatgtcggcaagtcagctggtttcccagtgcaggacgcgctgacagctcgagtgagcggactgcccaggacttcggaactagacgagttctgtagaaatcctgtcaaagaatatgaagaaaaacagagaaagattctgcaatagagagagagaatttgtatataaatttaaagtaggaagtcagtgcttagaactgagagtgccactcaaatttcctgttcaagagaatgccagtcatttgcatggacgtctgatgctgctgcacagtttaccgtgctttatagaaaaagacttaaaagaagctctgactcagtttatagaagaagaatccctcagcgattatgatagagatgctgaagcatccctggcagctgtgaaatcaggtgaagtagatttacatcagctggcgagtacatgggccaaagcttatgctgagaccacgttagagcatgcaaggcctgaagaacccagctgggatgaagattttgcagatgtgtaccatgacttaattcattctcctgcctctgaaactctcttaaatttggaacataattactttgttagtatctcagaactgattggtgaaagagatgtggagctgaaaaaattacgagagagacaaggtattgaaatggaaaaagtcatgcaggaattgggaaaatcactgacagatcaagatgtaaattcactggctgctcagcattttgaatcccagcaagacctagaaaataaatggtcgaatgaattaaaacaatcaactgccatccaaaaacaagagtatcaagaatgggtaataaaacttcaccaagacctaaaaaaccccaacaacagctcccttagtgaggaaattaaagttcagccaagtcagttcagagaatctgtagaagcaattggaaggatttatgaggaacagagaaagttagaagaaagttttaccattcacttaggagcccagttgaagaccatgcataatttgagattgctgagagcagatatgctggacttctgtaagcataaaagaaatcatcgaagtggtgtgaaacttcatcggctccaaacagctctgtcactttattctacatctctctgtggcctggttttactagtagataatcgaattaattcatatagtggtattaaaagagattttgccacagtttgccaagaatgcactgacttccatttcccccgaattgaagagcaattagaagttgtccaacaggtggtactttatgctagaacccagcgcaggagtaaattgaaagaatcacttgattctggaaaccaaaatggaggaaatgatgataagactaagaatgctgagaggaactatttaaatgttttacctggggaattttatattacacggcattctaatctctcagaaatccatgttgctttccatctctgtgtggatgaccatgtgaaatcgggaaacatcactgctcgtgatcctgccattatgggactccgaaatatactcaaagtttgctgtacccatgacatcacaacaataagcattcctctcttgctggtacatgatatgtcagaggaaatgactataccctggtgcttaaggagagcggaacttgtgttcaagtgtgtcaaaggtttcatgatggaaatggcttcatgggatggaggaatttctaggacagtgcaatttctagtaccacagagtatttctgaagaaatgttttatcaacttagtaacatgcttccccagatcttccgagtatcatcaacactcactctgacatccaagcactaaacccttatagattgacatgctggcagaagatgattgttaaactctccaggaacttgtgctatgctgggaatctgtcaagcaaaagatgcccagaaagagaacttgcagctcaatccacaaatcaagatacatgtgtgtgaaaccattccaaaaatttatatactgcacaaactggtgatcaacccctaacttaaacacttaaagtctctttatgaatttctctttttttcttctctgtgttacctgtgaatattagtaatctaaaactttttatttatcacacatggacacttgggaaaggaaacttgattatatttacatggaggcatttgactttttcaagaggcttgactcgtctcaggtgcaatccttaattaaacatacaaacaaaattttccttttactttctttgccaaaacaaaatgtaaaagcactgaaatatacattgcaagtacaaatttcctgtgaaaatctttttatagaaacacaaatgtataagacaaatgtgcttgttcttttaaattctcctgtttcagaatctctttttaatctactcctaaggatgtacaagttagagtcagaagacgttttggattttttccctctctctcatcctcccgctgtgcccttgcacttgcatattaataacatttcatggactgggaaatagtgttcttttttgcaagcttgatgtcaagttagtctaaaccagcacctggcagtattttagtgctcatcaacattgtgacaatcacacaaggaagatcatttctacatttctgtcctccctgcgttctcagcttgcttaaccattcctctacctcttgcatttttttgcggataaatgtatccccatttctgcttctctgtttcccctccttttccattgtttttccttatggtactactttctcaggtgctacatatcatatatttgtcccatctataacatatttaaatgctataagtagtaactccattaaacaaaggcatttacaaaagcacacaggtgtttagaaaagcaatagtttcatcaattccaagttatgtggatattgtaactggccacaagaatgaaatggagggcatttggtgtcataagatggcatgtcttgatgacaagaaacaaaacgcccttcattaatatgcctcagtgtaataactattatagaaactgttggcaagcagagtgctttcctataacagaatgtgtcttaattttctactcgagggaaaggtttgtccaggtaacaacactaaagacaaccctaagaacacccactccagcagtatgtccattagacactaaaactctccaaattatttgtcagggagcctggcgattctgccaagaaggcaggtgttttgcccttagagcctatacagttctcttggagaaattgtctttcaggcaccactgttaatcactgagactgattctaatgcaaagcagggaagacagaggcagaaaccaggagagtggtagatcagtgcagcccagatatcggaatggaggagcaaagtttcattcacggatgtttgttgaatgctgctgcccaactcttcctttgtcacctctaggctattccactaagttacttataaactggtggctttaactgagggctgtgtaaaggtactatttggcatgagcagggtccgtggagtggtgggagcagaagtcagtggcagcgctcgaggggtgagcaggcgtgaggaagtgcaggcagagtgatggcatctccccggctgctcttttacccacactggcaccacgc

SEQ ID NO: 297908 - DNA, 3681 bp, Homo sapiens
agcggtgggtgtggaaaaagtatgtcggcaagtcagctggtttcccagtgcaggacgcgctgacagctcgagtgagcggactgcccaggacttcggaactagacgagacttaaaagaagctctgactcagtttatagaagaagaatccctcagcgattatgatagagatgctgaagcatccctggcagctgtgaaatcaggtgaagtagatttacatcagctggcgagtacatgggccaaagcttatgctgagaccacgttagagcatgcaaggcctgaagaacccagctgggatgaagattttgcagatgtgtaccatgacttaattcattctcctgcctctgaaactctcttaaatttggaacataattactttgttagtatctcagaactgattggtgaaagagatgtggagctgaaaaaattacgagagagacaaggtattgaaatggaaaaagtcatgcaggaattgggaaaatcactgacagatcaagatgtaaattcactggctgctcagcattttgaatcccagcaagacctagaaaataaatggtcgaatgaattaaaacaatcaactgccatccaaaaacaagagtatcaagaatgggtaataaaacttcaccaagacctaaaaaaccccaacaacagctcccttagtgaggaaattaaagttcagccaagtcagttcagagaatctgtagaagcaattggaaggatttatgaggaacagagaaagttagaagaaagttttaccattcacttaggagcccagttgaagaccatgcataatttgagattgctgagagcagatatgctggacttctgtaagcataaaagaaatcatcgaagtggtgtgaaacttcatcggctccaaacagctctgtcactttattctacatctctctgtggcctggttttactagtagataatcgaattaattcatatagtggtattaaaagagattttgccacagtttgccaagaatgcactgacttccatttcccccgaattgaagagcaattagaagttgtccaacaggtggtactttatgctagaacccagcgcaggagtaaattgaaagaatcacttgattctggaaaccaaaatggaggaaatgatgataagactaagaatgctgagaggaactatttaaatgttttacctggggaattttatattacacggcattctaatctctcagaaatccatgttgctttccatctctgtgtggatgaccatgtgaaatcgggaaacatcactgctcgtgatcctgccattatgggactccgaaatatactcaaagtttgctgtacccatgacatcacaacaataagcattcctctcttgctggtacatgatatgtcagaggaaatgactataccctggtgcttaaggagagcggaacttgtgttcaagtgtgtcaaaggtttcatgatggaaatggcttcatgggatggaggaatttctaggacagtgcaatttctagtaccacagagtatttctgaagaaatgttttatcaacttagtaacatgcttccccagatcttccgagtatcatcaacactcactctgacatccaagcactaaacccttatagattgacatgctggcagaagatgattgttaaactctccaggaacttgtgctatgctgggaatctgtcaagcaaaagatgcccagaaagagaacttgcagctcaatccacaaatcaagatacatgtgtgtgaaaccattccaaaaatttatatactgcacaaactggtgatcaacccctaacttaaacacttaaagtctctttatgaatttctctttttttcttctctgtgttacctgtgaatattagtaatctaaaactttttatttatcacacatggacacttgggaaaggaaacttgattatatttacatggaggcatttgactttttcaagaggcttgactcgtctcaggtgcaatccttaattaaacatacaaacaaaattttccttttactttctttgccaaaacaaaatgtaaaagcactgaaatatacattgcaagtacaaatttcctgtgaaaatctttttatagaaacacaaatgtataagacaaatgtgcttgttcttttaaattctcctgtttcagaatctctttttaatctactcctaaggatgtacaagttagagtcagaagacgttttggattttttccctctctctcatcctcccgctgtgcccttgcacttgcatattaataacatttcatggactgggaaatagtgttcttttttgcaagcttgatgtcaagttagtctaaaccagcacctggcagtattttagtgctcatcaacattgtgacaatcacacaaggaagatcatttctacatttctgtcctccctgcgttctcagcttgcttaaccattcctctacctcttgcatttttttgcggataaatgtatccccatttctgcttctctgtttcccctccttttccattgtttttccttatggtactactttctcaggtgctacatatcatatatttgtcccatctataacatatttaaatgctataagtagtaactccattaaacaaaggcatttacaaaagcacacaggtgtttagaaaagcaatagtttcatcaattccaagttatgtggatattgtaactggccacaagaatgaaatggagggcatttggtgtcataagatggcatgtcttgatgacaagaaacaaaacgcccttcattaatatgcctcagtgtaataactattatagaaactgttggcaagcagagtgctttcctataacagaatgtgtcttaattttctactcgagggaaaggtttgtccaggtaacaacactaaagacaaccctaagaacacccactccagcagtatgtccattagacactaaaactctccaaattatttgtcagggagcctggcgattctgccaagaaggcaggtgttttgcccttagagcctatacagttctcttggagaaattgtctttcaggcaccactgttaatcactgagactgattctaatgcaaagcagggaagacagaggcagaaaccaggagagtggtagatcagtgcagcccagatatcggaatggaggagcaaagtttcattcacggatgtttgttgaatgctgctgcccaactcttcctttgtcacctctaggctattccactaagttacttataaactggtggctttaactgagggctgtgtaaaggtactatttggcatgtgaagtcaggataaatttatcgaatgtccgttttccacatgcaactgtgttacagaagtagtaaaattggaagaatcatgtttatggtgttaccactgatggaaacacacaaacaccaagctaataataaatatataacttaaaaagctaattatatgcactgaaatggtgggaattttagtgatgcagtaattgaggagtctggagttttgtatttggaccaagaattatgagatgaggatctttttctgagtgttctaaagggcttcttgagggggagtggtttaaagcacttcatgaatgatgtgaagaaggtaccttgggctgagacagcattctaggtacagatggcactctgttcaaccaactgtggatggaaaatattctgaaaaaaaatacaataaaaattttaaaaatacaatataacatctgtttacatggc

SEQ ID NO: 297909 - DNA, 3392 bp, Homo sapiens
agcggtgggtgtggaaaaagtatgtcggcaagtcagctggtttcccagtgcaggacgcgctgacagctcgagtgagcggactgcccaggacttcggaactagacgagacttaaaagaagctctgactcagtttatagaagaagaatccctcagcgattatgatagagatgctgaagcatccctggcagctgtgaaatcaggtgaagtagatttacatcagctggcgagtacatgggccaaagcttatgctgagacaaggtattgaaatggaaaaagtcatgcaggaattgggaaaatcactgacagatcaagatgtaaattcactggctgctcagcattttgaatcccagcaagacctagaaaataaatggtcgaatgaattaaaacaatcaactgccatccaaaaacaagagtatcaagaatgggtaataaaacttcaccaagacctaaaaaaccccaacaacagctcccttaggagcccagttgaagaccatgcataatttgagattgctgagagcagatatgctggacttctgtaagcataaaagaaatcatcgaagtggtgtgaaacttcatcggctccaaacagctctgtcactttattctacatctctctgtggcctggttttactagtagataatcgaattaattcatatagtggtattaaaagagattttgccacagtttgccaagaatgcactgacttccatttcccccgaattgaagagcaattagaagttgtccaacaggtggtactttatgctagaacccagcgcaggagtaaattgaaagaatcacttgattctggaaaccaaaatggaggaaatgatgataagactaagaatgctgagaggaactatttaaatgttttacctggggaattttatattacacggcattctaatctctcagaaatccatgttgctttccatctctgtgtggatgaccatgtgaaatcgggaaacatcactgctcgtgatcctgccattatgggactccgaaatatactcaaagtttgctgtacccatgacatcacaacaataagcattcctctcttgctggtacatgatatgtcagaggaaatgactataccctggtgcttaaggagagcggaacttgtgttcaagtgtgtcaaaggtttcatgatggaaatggcttcatgggatggaggaatttctaggacagtgcaatttctagtaccacagagtatttctgaagaaatgttttatcaacttagtaacatgcttccccagatcttccgagtatcatcaacactcactctgacatccaagcactaaacccttatagattgacatgctggcagaagatgattgttaaactctccaggaacttgtgctatgctgggaatctgtcaagcaaaagatgcccagaaagagaacttgcagctcaatccacaaatcaagatacatgtgtgtgaaaccattccaaaaatttatatactgcacaaactggtgatcaacccctaacttaaacacttaaagtctctttatgaatttctctttttttcttctctgtgttacctgtgaatattagtaatctaaaactttttatttatcacacatggacacttgggaaaggaaacttgattatatttacatggaggcatttgactttttcaagaggcttgactcgtctcaggtgcaatccttaattaaacatacaaacaaaattttccttttactttctttgccaaaacaaaatgtaaaagcactgaaatatacattgcaagtacaaatttcctgtgaaaatctttttatagaaacacaaatgtataagacaaatgtgcttgttcttttaaattctcctgtttcagaatctctttttaatctactcctaaggatgtacaagttagagtcagaagacgttttggattttttccctctctctcatcctcccgctgtgcccttgcacttgcatattaataacatttcatggactgggaaatagtgttcttttttgcaagcttgatgtcaagttagtctaaaccagcacctggcagtattttagtgctcatcaacattgtgacaatcacacaaggaagatcatttctacatttctgtcctccctgcgttctcagcttgcttaaccattcctctacctcttgcatttttttgcggataaatgtatccccatttctgcttctctgtttcccctccttttccattgtttttccttatggtactactttctcaggtgctacatatcatatatttgtcccatctataacatatttaaatgctataagtagtaactccattaaacaaaggcatttacaaaagcacacaggtgtttagaaaagcaatagtttcatcaattccaagttatgtggatattgtaactggccacaagaatgaaatggagggcatttggtgtcataagatggcatgtcttgatgacaagaaacaaaacgcccttcattaatatgcctcagtgtaataactattatagaaactgttggcaagcagagtgctttcctataacagaatgtgtcttaattttctactcgagggaaaggtttgtccaggtaacaacactaaagacaaccctaagaacacccactccagcagtatgtccattagacactaaaactctccaaattatttgtcagggagcctggcgattctgccaagaaggcaggtgttttgcccttagagcctatacagttctcttggagaaattgtctttcaggcaccactgttaatcactgagactgattctaatgcaaagcagggaagacagaggcagaaaccaggagagtggtagatcagtgcagcccagatatcggaatggaggagcaaagtttcattcacggatgtttgttgaatgctgctgcccaactcttcctttgtcacctctaggctattccactaagttacttataaactggtggctttaactgagggctgtgtaaaggtactatttggcatgtgaagtcaggataaatttatcgaatgtccgttttccacatgcaactgtgttacagaagtagtaaaattggaagaatcatgtttatggtgttaccactgatggaaacacacaaacaccaagctaataataaatatataacttaaaaagctaattatatgcactgaaatggtgggaattttagtgatgcagtaattgaggagtctggagttttgtatttggaccaagaattatgagatgaggatctttttctgagtgttctaaagggcttcttgagggggagtggtttaaagcacttcatgaatgatgtgaagaaggtaccttgggctgagacagcattctaggtacagatggcactctgttcaaccaactgtggatggaaaatattctgaaaaaaaatacaataaaaattttaaaaatacaatataacatctgtttacatggc

SEQ ID NO: 297910 - DNA, 2246 bp, Homo sapiens
agcggtgggtgtggaaaaagtatgtcggcaagtcagctggtttcccagtgcaggacgcgctgacagctcgagtgagcggactgcccaggacttcggaactagacgagttctgtagaaatcctgtcaaagaatatgaagaaaaacagagaaagattctgcaatagagagagagaatttgtatataaatttaaagtaggaagtcagtgcttagaactgagagtgccactcaaatttcctgttcaagagaatgccagtcatttgcatggacgtctgatgctgctgcacagtttaccgtgctttatagaaaaagacttaaaagaagctctgactcagtttatagaagaagaatccctcagcgattatgatagagatgctgaagcatccctggcagctgtgaaatcaggtgaagtagatttacatcagctggcgagtacatgggccaaagcttatgctgagaccacgttagagcatgcaaggcctgaagaacccagctgggatgaagattttgcagatgtgtaccatgacttaattcattctcctgcctctgaaactctcttaaatttggaacataattactttgttagtatctcagaactgattggtgaaagagatgtggagctgaaaaaattacgagagagacaaggtattgaaatggaaaaagtcatgcaggaattgggaaaatcactgacagatcaagatgtaaattcactggctgctcagcattttgaatcccagcaagacctagaaaataaatggtcgaatgaattaaaacaatcaactgccatccaaaaacaagagtatcaagaatgggtaataaaacttcaccaagacctaaaaaaccccaacaacagctcccttagtgaggaaattaaagttcagccaagtcagttcagagaatctgtagaagcaattggaaggatttatgaggaacagagaaagttagaagaaagttttaccattcacttaggagcccagttgaagaccatgcataatttgagattgctgagagcagatatgctggacttctgtaagcataaaagaaatcatcgaagtggtgtgaaacttcatcggctccaaacagctctgtcactttattctacatctctctgtggcctggttttactagtagataatcgaattaattcatatagtggtattaaaagagattttgccacagtttgccaagaatgcactgacttccatttcccccgaattgaagagcaattagaagttgtccaacaggtggtactttatgctagaacccagcgcaggagtaaattgaaagaatcacttgattctggaaaccaaaatggaggaaatgatgataagactaagaatgctgagaggaactatttaaatgttttacctggggaattttatattacacggcattctaatctctcagaaatccatgttgctttccatctctgtgtggatgaccatgtgaaatcgggaaacatcactgctcgtgatcctgccattatgggactccgaaatatactcaaagtttgctgtacccatgacatcacaacaataagcattcctctcttgctggtacatgatatgtcagaggaaatgactataccctggtgcttaaggagagcggaacttgtgttcaagtgtgtcaaaggtttcatgatggaaatggcttcatgggatggaggaatttctaggacagtgcaatttctagtaccacagagtatttctgaagaaatgttttatcaacttagtaacatgcttccccagatcttccgagtatcatcaacactcactctgacatccaagcactaaacccttatagattgacatgctggcagaagatgattgttaaactctccaggaacttgtgctatgctgggaatctgtcaagcaaaagatgcccagaaagagaacttgcagctcaatccacaaatcaagatacatgtgtgtgaaaccattccaaaaatttatatactgcacaaactggtgatcaacccctaacttaaacacttaaagtctctttatgaatttctctttttttcttctctgtgttacctgtgaatattagtaatctaaaactttttatttatcacacatggacacttgggaaaggaaacttgattatatttacatggaggcatttgactttttcaagaggcttgactcgtctcaggtgcaatccttaattaaacatacaaacaaaattttccttttactttctttgccaaaacaaaatgtaaaagcactgaaatatacattgcaagtac

SEQ ID NO: 297911 - DNA, 1188 bp, Homo sapiens
agcggtgggtgtggaaaaagtatgtcggcaagtcagctggtttcccagtgcaggacgcgctgacagctcgagtgagcggactgcccaggacttcggaactagacgagttctgtagaaatcctgtcaaagaatatgaagaaaaacagagaaagattctgcaatagagagagagaatttgtatataaatttaaagtaggaagtcagtgcttagaactgagagtgccactcaaatttcctgttcaagagaatgccagtcatttgcatggacgtctgatgctgctgcacagtttaccgtgctttatagaaaaagacttaaaagaagctctgactcagtttatagaagaagaatccctcagcgattatgatagagatgctgaagcatccctggcagctgtgaaatcaggtgaagtagatttacatcagctggcgagtacatgggccaaagcttatgctgagaccacgttagagcatgcaaggcctgaagaacccagctgggatgaagattttgcagatgtgtaccatgacttaattcattctcctgcctctgaaactctcttaaatttggaacataattactttgttagtatctcagaactgattggtgaaagagatgtggagctgaaaaaattacgagagagacaaggtattgaaatggaaaaagtcatgcaggaattgggaaaatcactgacagatcaagatgtaaattcactggctgctcagcattttgaatcccagcaagacctagaaaataaatggtcgaatgaattaaaacaatcaactgccatccaaaaacaagagtatcaagaatgggtaataaaacttcaccaagacctaaaaaaccccaacaacagctcccttaggtattaactatgtattgttcttattcatatagtagtccattgttagtaatgtttatatttactacaaagttaaaccttttagctgtatgtctttttaatttgctagtgaaagttcaagacaattttatgctgtgcttttaccaccttttgcattataggctttatgtggattatttggggggcaatggttattggttagtttgaaatagaactttagttttatgttctagatacatacacctaaatacttaaatactatctttatttctttagtttccactccatgcagtaaacattggttgaatgccaaacactctctaagcagaaa

SEQ ID NO: 297912 - DNA, 768 bp, Homo sapiens
gtggattgcttgagcccaggagttcaagaccagcctgggcaacacagcgagaccccatctcttaaaaatgtattttattttagccagtgggtcccttcctttctcctttcctctctactgctcaagaacagatttgaggccaggtgcggtgcctcacatctgtaatcccaacactttgggaggctgagatgggtggattgcttgagcccaggagttcaagaccagcctgggcaacacagcgagaccccatctcttaaaaaataacagacttgaggaacccctctcccttccataattcccctcatccaccgcccactccaggcactcactcaaacttgctcttcaactctgtatacaagcagaagcaataaaccaatctgattttcttttcaattaaaaaaaaaaaacaaaaaaaacaagaaaaaaaaaaaccaaaaagaaaaacaaaaaaacaacagaagtcaaacaacacgaaaaaacaaagaaagcaggagagggaggagcgcgaccgacccacagaagcacacaccacgagggagcaaaaaaaaaaaaaaaaaacaaaaactacacaaacaacagtcacacaaacgcggcgcggcgtcagaagctgatcaccggcgcacgggacgcaacaccgatccatccgccacacactgaaagcgggcgccctggaaggcaacacactatccggcggccccgcgccaaacacaccccggaggagaaccctccgcgcgacagcacaccccccctgtcggcgccagccggcgc

SEQ ID NO: 297913 - DNA, 507 bp, Homo sapiens
  misc_feature (21)..(21): n is a, c, g, or t
ctcggtacccgactgcatccnacgtcccaaccagcacggtccccgcagaatgccagcgcacctcctcccgccacttcaaagagccggctcggcggggcaggaagcggcggctgcggctgcgggtcctgcgagaagagcgcgatttcctccggggctgcccagttatctctggagtcgcagaactgctctcgggagaacgcgttctctaccccaaccccgtgctcctcaacccacccacctacttcctctagctccacacactcacaagcaccgagctgccaaaaatttccacccaccgcccccctccctagctaacttccttccagcatttcctgagctggatgatcctaggatttgtaagacaggaaaaaaaggaaggcgtgagggcgggcagcagcgacaggatgcttgtttttcgctctaccaaagtcgtctgaaggcgagacagcgggcccagggcgcaggacccaccgcggcgtggatgcagtcagcggcgttggatgcatc

SEQ ID NO: 297914 - DNA, 6689 bp, Homo sapiens
  misc_feature (21)..(21): n is a, c, g, or t
  misc_feature (1961)..(1961): n is a, c, g, or t
  misc_feature (2596)..(2596): n is a, c, g, or t
ctcggtacccgactgcatccnacgtcccaaccagcacggtccccgcagaatgccagcgcacctcctcccgccacttcaaagagccggctcggcggggcaggaagcggcggctgcggctgcgggtcctgcgagaagagcgcgatttcctccggggctgcccagttatctctggagtcgcagaactgctctcgggagaacgcgttctctaccccaaccccgtgctcctcaacccacccacctacttcctctagctccacacactcacaagcaccgagctgccaaaaatttccacccaccgcccccctccctagctaacttccttccagcatttcctgagctggatgatcctaggatttgtaagacaggaaaaaaaggaaggcgtgagggcgggcagcagcgacaggatgcttgtttttcgctctaccaaagtcgtctgaaggcgagacagcgggcccagggcgcaggacccaccgcagccccctgggcagtctcctcgccccgcgtccgcgtcgtctccggggcacttagtaaggggtggggagagcttgccctccctcttaagctgaggagaaacacccgaagacaccgcaggagcctgtgaaagtccctaggactccaagtgaggaagtgacactcccaggcgagccggcccgcggctgccagtctgcacggcctcggcacggcggccccggagcggcgcggggtggatctcaggctctgccggcccgcggcccgcggggtccatgcgcagggcccccagcccaagttcttccatcttccgatgcggccccccagagccgcggggcagccggtgatctagcccgggagcccatcttacagcggtgccaagcagaggggcggcagagacggaggggcagcctctttgggactaactcatgaagaacaagggtgctaagcagaagctgaaacgaaagggagccgccagcgcgtttggctgtgacctgacggagtatctggaaagctcgggacaggatgttccatacgttttgaagagctgtgcagaatttatagagactcacggcatcgtggatggaatctatcggctttcaggagtcacctcaaacatacaacggctaaggcaagagtttggctcagatcaatgtccagatctgacaagggaagtgtacctccaggacatccactgtgtgggctcgctttgcaagctctactttagggagctgcccaaccccctcctgacttatgagctctatgagaaattcacggaggcagtgtcgcattgccctgaagaaggccaactggcccgaatccaaaatgttatccaggagcttcctccatcccactataggaccttggaatacctgattcgacacctggcccatatcgcctccttcagcagcaagaccaacatgcacgcccggaacctggccctggtgtgggcgccaaacctcctcaggtctaaagaaattgaagccactggttgcaatggagatgcagccttccttgcagtccgggtccagcaggtggtgattgagttcatattgaatcatgtagatcaaatctttaacaacggtgcacctgggtctctggagaatgatgaaaaccggcccatcatgaagagcctgaccttgccagccctctccctgcccatgaagctggtgagccttgaggaagctcaagcccgcagcctggccactaaccatcctgctcgcaaggaaaggagggagaacagcctgcctgagattgtccctcccatgggcaccctcttccacactgtccttgagttaccagacaacaagcgaaagctctccagtaaatcaaagaagtggaaatcaatatttaacctgggacgttctggatcagactccaaatcaaaactgagtagaaatgggagtgtatttgtgagaggacagaggctctcggtggaaaaggctactatccgaccagctaaaagcatggactcactatgttcagtgcctgtngaaggaaaagaaaccaagggaaatttcaatcgaacagttaccaccggtggatttttcattccagcaacaaagatgcactccaccggcaccggcagctcatgtgacctcaccaagcaggagggcgaatggggccaggaggggatgcctcccggggctgagggtggctttgatgtgagcagtgatcgcagccatctccagggcgctcaggcccggcccccaccggaacagctgaaggttttccggcctgttgaggatccggagagcgagcaaacagccccaaagatgttgggtatgttctacacttcgaacgacagccctagcaaatccgtcttcaccagcagcctcttccagatggagccctcgccgcgtaaccagcgcaaggcgctgaacatctccgagccctttgcggtatctgtgccgctccgcgtgtccgcagtcatcagcaccaacagcacgccgtgcagaacacccccgaaggagctgcagtctctttccagcctggaagagttttcttttcatggatcagagagcggaggctggccagaagaagagaaaccgctgggagctgagacttctgcagcttctgtacctaagaaggcaggtcttgaggatccaaggcagtacctgaagcaccngggacagtggaatgcagcaaaggcctgtcccaggagccaggcgcccacctggaggagaagaaaaccccagaaagctccttgagctctcaacatttaaatgaattagagaagaggccaaatccggagaaggtggtggaggagggacgagaggctggtgagatggagtccagcaccctgcaggagagccccagggccagagccgaagctgtgcttctccatgagatggatgaagatgatctggccaatgccctgatctggcctgagattcaacaggagctgaaaatcattgaatctgaggaggagctctcatcgttgccacctcctgctctgaagaccagcccaattcagcctattctcgagtcgagtctggggccctttattccctcagagcctcctgggagcttgccttgtggctccttccctgctccagtctccacccctctggaggtgtggactagggatccagccaatcagagcacacagggggcttccacagcagccagcagagagaagccggaacctgagcagggcctgcacccagacctcgccagcctggctcctctggaaatagttccttttgagaaggcatctccacaagcaacagtggaagtaggaggcccaggcaatctgtctcctccactcccacctgctcctccccctccaactcctctggaggagtcaactccagtcctgctttcaaagggcagcccggaaagagaagactcatccaggaaattgaggacagatctctacatagaccagctgaagtcccaagacagccctgagatctctagcctctgtcagggagaggaggcaaccccaagacacagtgacaagcaaaattcaaagaatgctgcttctgaggggaaaggctgtggttttccaagcccaaccagggaggttgagatcgtctcacaagaagaggaggatgtaacccattcagtacaggagccttcagactgtgacgaagatgacactgtgacagacattgcccagcatggcctggagatggtggagccctgggaggaaccccagtgggtgacgagtccccttcactctcccaccctgaaagacgcgcacaaggcccaggtacagggccttcagggtcaccagttggagaagaggctttcccacaggcccagccttcgccagagccattctctagatagcaaacccacggttaaaagccagtggactctcgaggttccctcctccagcagctgtgctaatcttgaaacagagaggaattctgaccctcttcagccccaggcacccaggagagagattactggatgggatgagaaagccctgaggtccttcagagagttctctggcctgaaaggggcagaggctcctcccaaccagaagggaccaagtggtgtgcaacccaacccagcagaaaccagccccatcagcctagcagagggaaaggagctagggacacacctggggcacagcagtccacagattaggcaaggtggtgttcctgggccagagagcagcaaggagagttcacccagcgtgcaggacagcacttcgcctggagagcaccccgcaaagttacagctaaagagcacagagtgtgggcccccaaaagggaaaaacaggccttcttccctcaacttggaccctgccattcccattgctgacctcttctggtttgagaatgtggcctcatttagttcacctggaatgcaggtctctgagccaggagacccaaaggtcacatggatgacctcatcttactgtaaagcagacccctggagggtttactcccaggacccccaggacctggacattgttgctcatgcactgacaggccgccgtaactcagctcctgtgagtgtgtcagctgtgagaacctccttcatggtcaaaatgtgccaggccagggcggtcccagtcatccctcccaagattcagtacacccagatcccacagcccctgccctctcagagctcaggggagaatggggttcagcctctggagaggagccaggagggacccagctcaaccagtgggaccactcagaaacctgccaaagatgattctccctcctccctggaaagctcaaaggaagaaaaaccaaagcaagatcccggagccattaagtcctcaccagtggatgccactgcaccctgcatgtgcgagggacctaccctttctccagaaccaggctcgtctaacctgctctccacccaggatgcagtagtgcaatgcagaaagcgcatgtcagagacagagccatctggggacaaccttctttcttcaaaactagagcgaccatctgggggttctaagcctttccacaggtcaaggccaggaagacctcagagcctaatcttattcagtcctcctttccccattatggaccacctgcccccttcatccacagtgacagattccaaggtcctgctgtcccctatcagaagtcccacccagacagtttcccctggccttctttgtggagagttggcagaaaacacatgggtcacaccagaaggggttacacttaggaataaaatgaccatccctaagaatggccagagactagagacctcaaccagctgtttttaccagcctcagcggagatcagtaattctggatggaagaagtgggaggcaaatagaatgatttcggttcacctgctggtgtctgaaaaaaaccgtgattcatctggaagttattacagggccagcttgccatattccaggcacacgttatcaagtttgggcctattgtggcctctgacttctctttcttcagccttttgaccacttattaattagtccatttgctagaagagtggtcaagggaaaaacgagagatgaaatttagttaagtctatgtgagcaagtgagagaaggttaggtaaggggagaggatggaatgcttgcctccaatgaactttggagcttgtatgtgagtcagattgctcccctattgctattatctattactcttgagagctggctgtcctttgaaagaaagaagtaatgttctttgaaagaaagaaaaatctcttgctgtgtcaaacctcaaaatgttgctattggggttagaaggcctcctctttatgctttttaatgctctttcaaacgtgttcttttagaccagttttctaataagctttgtaaaatgtactatccaaattagaagcggatttggaaatgcaaactaacgtgcacttagatatccaagtgggtgagcttagccactcttacccatgctctttccctggaatccctggagacctgtccaagatgatttccatataccagcatagaaaatcagaatcaagagcaaactctgagactggcacaatccaagaagatttcctggctctggcttttagtaatttgggactccaactgccactgtactggactgtaatttataaatccagtagctacgcagggtggaggctgggctgaggattaccataatgaaatgtactaaatcttcatttaggtatgcaattgtgaagtgaaggcatctgctttctttacagtatcagagtccaagaacaggatgtcaccatagataaaagcctcatacaaaggcagaactacactccaaatttaatgtgtttaaattggtggggcaccagcagaaaatacttctagctcagctttactcttcttccacactaggctgggcccagcaatacaggagaggatgaagggaggagctccaggaggcgagggaagagccctagcagggcggccatcacaaccactcactgagagttgcccttcttaaaaatgtattttattttagccagtgggtcccttcctttctcctttcctctctactgctcaagaacagatttgaggccaggtgcggtgcctcacatctgtaatcccaacactttgggaggctgagatgggtggattgcttgagcccaggagttcaagaccagcctgggcaacacagcgagaccccatctcttaaaaaataacagacttgaggaacccctctcccttccataattcccctcatccaccgcccactccaggcactcactcaaacttgctcttcaactctgtatacaagcagaagcaataaaccaatctgattttcttttcaatta

SEQ ID NO: 297915 - DNA, 7666 bp, Homo sapiens
  misc_feature (21)..(21): n is a, c, g, or t
  misc_feature (1961)..(1961): n is a, c, g, or t
  misc_feature (2596)..(2596): n is a, c, g, or t
ctcggtacccgactgcatccnacgtcccaaccagcacggtccccgcagaatgccagcgcacctcctcccgccacttcaaagagccggctcggcggggcaggaagcggcggctgcggctgcgggtcctgcgagaagagcgcgatttcctccggggctgcccagttatctctggagtcgcagaactgctctcgggagaacgcgttctctaccccaaccccgtgctcctcaacccacccacctacttcctctagctccacacactcacaagcaccgagctgccaaaaatttccacccaccgcccccctccctagctaacttccttccagcatttcctgagctggatgatcctaggatttgtaagacaggaaaaaaaggaaggcgtgagggcgggcagcagcgacaggatgcttgtttttcgctctaccaaagtcgtctgaaggcgagacagcgggcccagggcgcaggacccaccgcagccccctgggcagtctcctcgccccgcgtccgcgtcgtctccggggcacttagtaaggggtggggagagcttgccctccctcttaagctgaggagaaacacccgaagacaccgcaggagcctgtgaaagtccctaggactccaagtgaggaagtgacactcccaggcgagccggcccgcggctgccagtctgcacggcctcggcacggcggccccggagcggcgcggggtggatctcaggctctgccggcccgcggcccgcggggtccatgcgcagggcccccagcccaagttcttccatcttccgatgcggccccccagagccgcggggcagccggtgatctagcccgggagcccatcttacagcggtgccaagcagaggggcggcagagacggaggggcagcctctttgggactaactcatgaagaacaagggtgctaagcagaagctgaaacgaaagggagccgccagcgcgtttggctgtgacctgacggagtatctggaaagctcgggacaggatgttccatacgttttgaagagctgtgcagaatttatagagactcacggcatcgtggatggaatctatcggctttcaggagtcacctcaaacatacaacggctaaggcaagagtttggctcagatcaatgtccagatctgacaagggaagtgtacctccaggacatccactgtgtgggctcgctttgcaagctctactttagggagctgcccaaccccctcctgacttatgagctctatgagaaattcacggaggcagtgtcgcattgccctgaagaaggccaactggcccgaatccaaaatgttatccaggagcttcctccatcccactataggaccttggaatacctgattcgacacctggcccatatcgcctccttcagcagcaagaccaacatgcacgcccggaacctggccctggtgtgggcgccaaacctcctcaggtctaaagaaattgaagccactggttgcaatggagatgcagccttccttgcagtccgggtccagcaggtggtgattgagttcatattgaatcatgtagatcaaatctttaacaacggtgcacctgggtctctggagaatgatgaaaaccggcccatcatgaagagcctgaccttgccagccctctccctgcccatgaagctggtgagccttgaggaagctcaagcccgcagcctggccactaaccatcctgctcgcaaggaaaggagggagaacagcctgcctgagattgtccctcccatgggcaccctcttccacactgtccttgagttaccagacaacaagcgaaagctctccagtaaatcaaagaagtggaaatcaatatttaacctgggacgttctggatcagactccaaatcaaaactgagtagaaatgggagtgtatttgtgagaggacagaggctctcggtggaaaaggctactatccgaccagctaaaagcatggactcactatgttcagtgcctgtngaaggaaaagaaaccaagggaaatttcaatcgaacagttaccaccggtggatttttcattccagcaacaaagatgcactccaccggcaccggcagctcatgtgacctcaccaagcaggagggcgaatggggccaggaggggatgcctcccggggctgagggtggctttgatgtgagcagtgatcgcagccatctccagggcgctcaggcccggcccccaccggaacagctgaaggttttccggcctgttgaggatccggagagcgagcaaacagccccaaagatgttgggtatgttctacacttcgaacgacagccctagcaaatccgtcttcaccagcagcctcttccagatggagccctcgccgcgtaaccagcgcaaggcgctgaacatctccgagccctttgcggtatctgtgccgctccgcgtgtccgcagtcatcagcaccaacagcacgccgtgcagaacacccccgaaggagctgcagtctctttccagcctggaagagttttcttttcatggatcagagagcggaggctggccagaagaagagaaaccgctgggagctgagacttctgcagcttctgtacctaagaaggcaggtcttgaggatccaaggcagtacctgaagcaccngggacagtggaatgcagcaaaggcctgtcccaggagccaggcgcccacctggaggagaagaaaaccccagaaagctccttgagctctcaacatttaaatgaattagagaagaggccaaatccggagaaggtggtggaggagggacgagaggctggtgagatggagtccagcaccctgcaggagagccccagggccagagccgaagctgtgcttctccatgagatggatgaagatgatctggccaatgccctgatctggcctgagattcaacaggagctgaaaatcattgaatctgaggaggagctctcatcgttgccacctcctgctctgaagaccagcccaattcagcctattctcgagtcgagtctggggccctttattccctcagagcctcctgggagcttgccttgtggctccttccctgctccagtctccacccctctggaggtgtggactagggatccagccaatcagagcacacagggggcttccacagcagccagcagagagaagccggaacctgagcagggcctgcacccagacctcgccagcctggctcctctggaaatagttccttttgagaaggcatctccacaagcaacagtggaagtaggaggcccaggcaatctgtctcctccactcccacctgctcctccccctccaactcctctggaggagtcaactccagtcctgctttcaaagggcagcccggaaagagaagactcatccaggaaattgaggacagatctctacatagaccagctgaagtcccaagacagccctgagatctctagcctctgtcagggagaggaggcaaccccaagacacagtgacaagcaaaattcaaagaatgctgcttctgaggggaaaggctgtggttttccaagcccaaccagggaggttgagatcgtctcacaagaagaggaggatgtaacccattcagtacaggagccttcagactgtgacgaagatgacactgtgacagacattgcccagcatggcctggagatggtggagccctgggaggaaccccagtgggtgacgagtccccttcactctcccaccctgaaagacgcgcacaaggcccaggtacagggccttcagggtcaccagttggagaagaggctttcccacaggcccagccttcgccagagccattctctagatagcaaacccacggttaaaagccagtggactctcgaggttccctcctccagcagctgtgctaatcttgaaacagagaggaattctgaccctcttcagccccaggcacccaggagagagattactggatgggatgagaaagccctgaggtccttcagagagttctctggcctgaaaggggcagaggctcctcccaaccagaagggaccaagtggtgtgcaacccaacccagcagaaaccagccccatcagcctagcagagggaaaggagctagggacacacctggggcacagcagtccacagattaggcaaggtggtgttcctgggccagagagcagcaaggagagttcacccagcgtgcaggacagcacttcgcctggagagcaccccgcaaagttacagctaaagagcacagagtgtgggcccccaaaagggaaaaacaggccttcttccctcaacttggaccctgccattcccattgctgacctcttctggtttgagaatgtggcctcatttagttcacctggaatgcaggtctctgagccaggagacccaaaggtcacatggatgacctcatcttactgtaaagcagacccctggagggtttactcccaggacccccaggacctggacattgttgctcatgcactgacaggccgccgtaactcagctcctgtgagtgtgtcagctgtgagaacctccttcatggtcaaaatgtgccaggccagggcggtcccagtcatccctcccaagattcagtacacccagatcccacagcccctgccctctcagagctcaggggagaatggggttcagcctctggagaggagccaggagggacccagctcaaccagtgggaccactcagaaacctgccaaagatgattctccctcctccctggaaagctcaaaggaagaaaaaccaaagcaagatcccggagccattaagtcctcaccagtggatgccactgcaccctgcatgtgcgagggacctaccctttctccagaaccaggctcgtctaacctgctctccacccaggatgcagtagtgcaatgcagaaagcgcatgtcagagacagagccatctggggacaaccttctttcttcaaaactagagcgaccatctgggggttctaagcctttccacaggtcaaggccaggaagacctcagagcctaatcttattcagtcctcctttccccattatggaccacctgcccccttcatccacagtgacagattccaaggtcctgctgtcccctatcagaagtcccacccagacagtttcccctggccttctttgtggagagttggcagaaaacacatgggtcacaccagaaggggttacacttaggaataaaatgaccatccctaagaatggccagagactagagacctcaaccagctgtttttaccagcctcagcggagatcagtaattctggatggaagaagtgggaggcaaatagaatgatttcggttcacctgctggtgtctgaaaaaaaccgtgattcatctggaagttattacagggccagcttgccatattccaggcacacgttatcaagtttgggcctattgtggcctctgacttctctttcttcagccttttgaccacttattaattagtccatttgctagaagagtggtcaagggaaaaacgagagatgaaatttagttaagtctatgtgagcaagtgagagaaggttaggtaaggggagaggatggaatgcttgcctccaatgaactttggagcttgtatgtgagtcagattgctcccctattgctattatctattactcttgagagctggctgtcctttgaaagaaagaagtaatgttctttgaaagaaagaaaaatctcttgctgtgtcaaacctcaaaatgttgctattggggttagaaggcctcctctttatgctttttaatgctctttcaaacgtgttcttttagaccagttttctaataagctttgtaaaatgtactatccaaattagaagcggatttggaaatgcaaactaacgtgcacttagatatccaagtgggtgagcttagccactcttacccatgctctttccctggaatccctggagacctgtccaagatgatttccatataccagcatagaaaatcagaatcaagagcaaactctgagactggcacaatccaagaagatttcctggctctggcttttagtaatttgggactccaactgccactgtactggactgtaatttataaatccagtagctacgcagggtggaggctgggctgaggattaccataatgaaatgtactaaatcttcatttaggtatgcaattgtgaagtgaaggcatctgctttctttacagtatcagagtccaagaacaggatgtcaccatagataaaagcctcatacaaaggcagaactacactccaaatttaatgtgtttaaattggtggggcaccagcagaaaatacttctagctcagctttactcttcttccacactaggctgggcccagcaatacaggagaggatgaagggaggagctccaggaggcgagggaagagccctagcagggcggccatcacaaccactcactgagagttgcccttcttaaaaatgtattttattttagccagtgggtcccttcctttctcctttcctctctactgctcaagaacagatttgaggccaggtgcggtgcctcacatctgtaatcccaacactttgggaggctgagatgggtggattgcttgagcccaggagttcaagaccagcctgggcaacacagcgagaccccatctcttaaaaaataacagacttgaggaacccctctcccttccataattcccctcatccaccgcccactccaggcactcactcaaacttgctcttcaactctgtatacaagcagaagcaataaaccaatctgattttcttttcaattatttataactttcaatggttctttcctttccagctggcgagagaaaggagaactaatatacctgctggcagatttttggtgctgcccaaaaaaggacttcacagggcatctcttctcaggttcaagcctggctgaattctgcccagaagctcagtcattgcagaaatttctctaagggctgatagtacctctgggtaggcgtcacaaccaaggctggttctgggcttagtgggggctgagatgaagttacctcctccaatgagaaattgggagctgatgccctgcaacagatatatattcctctctctctctgtctctctatctctctcctccctctccctccctccctccccgccaataagccttacaaacagttttgaaatcttgttctgtaccttttaagccagtgtctgtggcgagggtgactggcaagtcagctgatgagttctgccttctgagagcactgagtgagcaaggcctttcatcagtgttttggccttctcattgggtgaggaagacattgaaccaacagccaacgagatatgaacctgtaagaaaaaagtcctagaatatagtatttttccccaggccagcaaagtgaagaaatacagtggtgacagatgagaaaggccatgttcaagagatctgaaaagtacattcctgccttatcagaaaatgtgtcagacaggttttatgtcagcctcagtgctcctgcggtgtcgacgctctgataaggaccatgttccagttagaatgcgagggagggaaagagctgcactttgcttcaccatcagaactctgagccaaataatgaatatgtaaactattttatgattattttaaatgtttgtttggtaacatttataagatctatttttatttggggatagactgagaagccaccatttacatattaacaagtgacttcagttctaagggttgagatgcctgtgtggatttataaaatggttgcaagat

SEQ ID NO: 297916 - DNA, 3951 bp, Homo sapiens
gctgtctggctcagtccatgagagagttcacagcagcttgcagagcatttctaatggaaccacgtaaaccagtggactctcgaggttccctcctccagcagctgtgctaatcttgaaacagagaggaattctgaccctcttcagccccaggcacccaggagagagattactggatgggatgagaaagccctgaggtccttcagagagttctctggcctgaaaggggcagaggctcctcccaaccagaagggaccaagtggtgtgcaacccaacccagcagaaaccagccccatcagcctagcagagggaaaggagctagggacacacctggggcacagcagtccacagattaggcaaggtggtgttcctgggccagagagcagcaaggagagttcacccagcgtgcaggacagcacttcgcctggagagcaccccgcaaagttacagctaaagagcacagagtgtgggcccccaaaagggaaaaacaggccttcttccctcaacttggaccctgccattcccattgctgacctcttctggtttgagaatgtggcctcatttagttcacctggaatgcaggtctctgagccaggagacccaaaggtcacatggatgacctcatcttactgtaaagcagacccctggagggtttactcccaggacccccaggacctggacattgttgctcatgcactgacaggccgccgtaactcagctcctgtgagtgtgtcagctgtgagaacctccttcatggtcaaaatgtgccaggccagggcggtcccagtcatccctcccaagattcagtacacccagatcccacagcccctgccctctcagagctcaggggagaatggggttcagcctctggagaggagccaggagggacccagctcaaccagtgggaccactcagaaacctgccaaagatgattctccctcctccctggaaagctcaaaggaagaaaaaccaaagcaagatcccggagccattaagtcctcaccagtggatgccactgcaccctgcatgtgcgagggacctaccctttctccagaaccaggctcgtctaacctgctctccacccaggatgcagtagtgcaatgcagaaagcgcatgtcagagacagagccatctggggacaaccttctttcttcaaaactagagcgaccatctgggggttctaagcctttccacaggtcaaggccaggaagacctcagagcctaatcttattcagtcctcctttccccattatggaccacctgcccccttcatccacagtgacagattccaaggtcctgctgtcccctatcagaagtcccacccagacagtttcccctggccttctttgtggagagttggcagaaaacacatgggtcacaccagaaggggttacacttaggaataaaatgaccatccctaagaatggccagagactagagacctcaaccagctgtttttaccagcctcagcggagatcagtaattctggatggaagaagtgggaggcaaatagaatgatttcggttcacctgctggtgtctgaaaaaaaccgtgattcatctggaagttattacagggccagcttgccatattccaggcacacgttatcaagtttgggcctattgtggcctctgacttctctttcttcagccttttgaccacttattaattagtccatttgctagaagagtggtcaagggaaaaacgagagatgaaatttagttaagtctatgtgagcaagtgagagaaggttaggtaaggggagaggatggaatgcttgcctccaatgaactttggagcttgtatgtgagtcagattgctcccctattgctattatctattactcttgagagctggctgtcctttgaaagaaagaagtaatgttctttgaaagaaagaaaaatctcttgctgtgtcaaacctcaaaatgttgctattggggttagaaggcctcctctttatgctttttaatgctctttcaaacgtgttcttttagaccagttttctaataagctttgtaaaatgtactatccaaattagaagcggatttggaaatgcaaactaacgtgcacttagatatccaagtgggtgagcttagccactcttacccatgctctttccctggaatccctggagacctgtccaagatgatttccatataccagcatagaaaatcagaatcaagagcaaactctgagactggcacaatccaagaagatttcctggctctggcttttagtaatttgggactccaactgccactgtactggactgtaatttataaatccagtagctacgcagggtggaggctgggctgaggattaccataatgaaatgtactaaatcttcatttaggtatgcaattgtgaagtgaaggcatctgctttctttacagtatcagagtccaagaacaggatgtcaccatagataaaagcctcatacaaaggcagaactacactccaaatttaatgtgtttaaattggtggggcaccagcagaaaatacttctagctcagctttactcttcttccacactaggctgggcccagcaatacaggagaggatgaagggaggagctccaggaggcgagggaagagccctagcagggcggccatcacaaccactcactgagagttgcccttcttaaaaatgtattttattttagccagtgggtcccttcctttctcctttcctctctactgctcaagaacagatttgaggccaggtgcggtgcctcacatctgtaatcccaacactttgggaggctgagatgggtggattgcttgagcccaggagttcaagaccagcctgggcaacacagcgagaccccatctcttaaaaaataacagacttgaggaacccctctcccttccataattcccctcatccaccgcccactccaggcactcactcaaacttgctcttcaactctgtatacaagcagaagcaataaaccaatctgattttcttttcaattatttataactttcaatggttctttcctttccagctggcgagagaaaggagaactaatatacctgctggcagatttttggtgctgcccaaaaaaggacttcacagggcatctcttctcaggttcaagcctggctgaattctgcccagaagctcagtcattgcagaaatttctctaagggctgatagtacctctgggtaggcgtcacaaccaaggctggttctgggcttagtgggggctgagatgaagttacctcctccaatgagaaattgggagctgatgccctgcaacagatatatattcctctctctctctgtctctctatctctctcctccctctccctccctccctccccgccaataagccttacaaacagttttgaaatcttgttctgtaccttttaagccagtgtctgtggcgagggtgactggcaagtcagctgatgagttctgccttctgagagcactgagtgagcaaggcctttcatcagtgttttggccttctcattgggtgaggaagacattgaaccaacagccaacgagatatgaacctgtaagaaaaaagtcctagaatatagtatttttccccaggccagcaaagtgaagaaatacagtggtgacagatgagaaaggccatgttcaagagatctgaaaagtacattcctgccttatcagaaaatgtgtcagacaggttttatgtcagcctcagtgctcctgcggtgtcgacgctctgataaggaccatgttccagttagaatgcgagggagggaaagagctgcactttgcttcaccatcagaactctgagccaaataatgaatatgtaaactattttatgattattttaaatgtttgtttggtaacatttataagatctatttttatttggggatagactgagaagccaccatttacatattaacaagtgacttcagttctaagggttgagatgcctgtgtggatttataaaatggttgcaagat

SEQ ID NO: 297917 - DNA, 9860 bp, Homo sapiens
  misc_feature (21)..(21): n is a, c, g, or t
  misc_feature (1961)..(1961): n is a, c, g, or t
  misc_feature (2596)..(2596): n is a, c, g, or t
ctcggtacccgactgcatccnacgtcccaaccagcacggtccccgcagaatgccagcgcacctcctcccgccacttcaaagagccggctcggcggggcaggaagcggcggctgcggctgcgggtcctgcgagaagagcgcgatttcctccggggctgcccagttatctctggagtcgcagaactgctctcgggagaacgcgttctctaccccaaccccgtgctcctcaacccacccacctacttcctctagctccacacactcacaagcaccgagctgccaaaaatttccacccaccgcccccctccctagctaacttccttccagcatttcctgagctggatgatcctaggatttgtaagacaggaaaaaaaggaaggcgtgagggcgggcagcagcgacaggatgcttgtttttcgctctaccaaagtcgtctgaaggcgagacagcgggcccagggcgcaggacccaccgcagccccctgggcagtctcctcgccccgcgtccgcgtcgtctccggggcacttagtaaggggtggggagagcttgccctccctcttaagctgaggagaaacacccgaagacaccgcaggagcctgtgaaagtccctaggactccaagtgaggaagtgacactcccaggcgagccggcccgcggctgccagtctgcacggcctcggcacggcggccccggagcggcgcggggtggatctcaggctctgccggcccgcggcccgcggggtccatgcgcagggcccccagcccaagttcttccatcttccgatgcggccccccagagccgcggggcagccggtgatctagcccgggagcccatcttacagcggtgccaagcagaggggcggcagagacggaggggcagcctctttgggactaactcatgaagaacaagggtgctaagcagaagctgaaacgaaagggagccgccagcgcgtttggctgtgacctgacggagtatctggaaagctcgggacaggatgttccatacgttttgaagagctgtgcagaatttatagagactcacggcatcgtggatggaatctatcggctttcaggagtcacctcaaacatacaacggctaaggcaagagtttggctcagatcaatgtccagatctgacaagggaagtgtacctccaggacatccactgtgtgggctcgctttgcaagctctactttagggagctgcccaaccccctcctgacttatgagctctatgagaaattcacggaggcagtgtcgcattgccctgaagaaggccaactggcccgaatccaaaatgttatccaggagcttcctccatcccactataggaccttggaatacctgattcgacacctggcccatatcgcctccttcagcagcaagaccaacatgcacgcccggaacctggccctggtgtgggcgccaaacctcctcaggtctaaagaaattgaagccactggttgcaatggagatgcagccttccttgcagtccgggtccagcaggtggtgattgagttcatattgaatcatgtagatcaaatctttaacaacggtgcacctgggtctctggagaatgatgaaaaccggcccatcatgaagagcctgaccttgccagccctctccctgcccatgaagctggtgagccttgaggaagctcaagcccgcagcctggccactaaccatcctgctcgcaaggaaaggagggagaacagcctgcctgagattgtccctcccatgggcaccctcttccacactgtccttgagttaccagacaacaagcgaaagctctccagtaaatcaaagaagtggaaatcaatatttaacctgggacgttctggatcagactccaaatcaaaactgagtagaaatgggagtgtatttgtgagaggacagaggctctcggtggaaaaggctactatccgaccagctaaaagcatggactcactatgttcagtgcctgtngaaggaaaagaaaccaagggaaatttcaatcgaacagttaccaccggtggatttttcattccagcaacaaagatgcactccaccggcaccggcagctcatgtgacctcaccaagcaggagggcgaatggggccaggaggggatgcctcccggggctgagggtggctttgatgtgagcagtgatcgcagccatctccagggcgctcaggcccggcccccaccggaacagctgaaggttttccggcctgttgaggatccggagagcgagcaaacagccccaaagatgttgggtatgttctacacttcgaacgacagccctagcaaatccgtcttcaccagcagcctcttccagatggagccctcgccgcgtaaccagcgcaaggcgctgaacatctccgagccctttgcggtatctgtgccgctccgcgtgtccgcagtcatcagcaccaacagcacgccgtgcagaacacccccgaaggagctgcagtctctttccagcctggaagagttttcttttcatggatcagagagcggaggctggccagaagaagagaaaccgctgggagctgagacttctgcagcttctgtacctaagaaggcaggtcttgaggatccaaggcagtacctgaagcaccngggacagtggaatgcagcaaaggcctgtcccaggagccaggcgcccacctggaggagaagaaaaccccagaaagctccttgagctctcaacatttaaatgaattagagaagaggccaaatccggagaaggtggtggaggagggacgagaggctggtgagatggagtccagcaccctgcaggagagccccagggccagagccgaagctgtgcttctccatgagatggatgaagatgatctggccaatgccctgatctggcctgagattcaacaggagctgaaaatcattgaatctgaggaggagctctcatcgttgccacctcctgctctgaagaccagcccaattcagcctattctcgagtcgagtctggggccctttattccctcagagcctcctgggagcttgccttgtggctccttccctgctccagtctccacccctctggaggtgtggactagggatccagccaatcagagcacacagggggcttccacagcagccagcagagagaagccggaacctgagcagggcctgcacccagacctcgccagcctggctcctctggaaatagttccttttgagaaggcatctccacaagcaacagtggaagtaggaggcccaggcaatctgtctcctccactcccacctgctcctccccctccaactcctctggaggagtcaactccagtcctgctttcaaagggcagcccggaaagagaagactcatccaggaaattgaggacagatctctacatagaccagctgaagtcccaagacagccctgagatctctagcctctgtcagggagaggaggcaaccccaagacacagtgacaagcaaaattcaaagaatgctgcttctgaggggaaaggctgtggttttccaagcccaaccagggaggttgagatcgtctcacaagaagaggaggatgtaacccattcagtacaggagccttcagactgtgacgaagatgacactgtgacagacattgcccagcatggcctggagatggtggagccctgggaggaaccccagtgggtgacgagtccccttcactctcccaccctgaaagacgcgcacaaggcccaggtacagggccttcagggtcaccagttggagaagaggctttcccacaggcccagccttcgccagagccattctctagatagcaaacccacggttaaaagccagtggactctcgaggttccctcctccagcagctgtgctaatcttgaaacagagaggaattctgaccctcttcagccccaggcacccaggagagagattactggatgggatgagaaagccctgaggtccttcagagagttctctggcctgaaaggggcagaggctcctcccaaccagaagggaccaagtggtgtgcaacccaacccagcagaaaccagccccatcagcctagcagagggaaaggagctagggacacacctggggcacagcagtccacagattaggcaaggtggtgttcctgggccagagagcagcaaggagagttcacccagcgtgcaggacagcacttcgcctggagagcaccccgcaaagttacagctaaagagcacagagtgtgggcccccaaaagggaaaaacaggccttcttccctcaacttggaccctgccattcccattgctgacctcttctggtttgagaatgtggcctcatttagttcacctggaatgcaggtctctgagccaggagacccaaaggtcacatggatgacctcatcttactgtaaagcagacccctggagggtttactcccaggacccccaggacctggacattgttgctcatgcactgacaggccgccgtaactcagctcctgtgagtgtgtcagctgtgagaacctccttcatggtcaaaatgtgccaggccagggcggtcccagtcatccctcccaagattcagtacacccagatcccacagcccctgccctctcagagctcaggggagaatggggttcagcctctggagaggagccaggagggacccagctcaaccagtgggaccactcagaaacctgccaaagatgattctccctcctccctggaaagctcaaaggaagaaaaaccaaagcaagatcccggagccattaagtcctcaccagtggatgccactgcaccctgcatgtgcgagggacctaccctttctccagaaccaggctcgtctaacctgctctccacccaggatgcagtagtgcaatgcagaaagcgcatgtcagagacagagccatctggggacaaccttctttcttcaaaactagagcgaccatctgggggttctaagcctttccacaggtcaaggccaggaagacctcagagcctaatcttattcagtcctcctttccccattatggaccacctgcccccttcatccacagtgacagattccaaggtcctgctgtcccctatcagaagtcccacccagacagtttcccctggccttctttgtggagagttggcagaaaacacatgggtcacaccagaaggggttacacttaggaataaaatgaccatccctaagaatggccagagactagagacctcaaccagctgtttttaccagcctcagcggagatcagtaattctggatggaagaagtgggaggcaaatagaatgatttcggttcacctgctggtgtctgaaaaaaaccgtgattcatctggaagttattacagggccagcttgccatattccaggcacacgttatcaagtttgggcctattgtggcctctgacttctctttcttcagccttttgaccacttattaattagtccatttgctagaagagtggtcaagggaaaaacgagagatgaaatttagttaagtctatgtgagcaagtgagagaaggttaggtaaggggagaggatggaatgcttgcctccaatgaactttggagcttgtatgtgagtcagattgctcccctattgctattatctattactcttgagagctggctgtcctttgaaagaaagaagtaatgttctttgaaagaaagaaaaatctcttgctgtgtcaaacctcaaaatgttgctattggggttagaaggcctcctctttatgctttttaatgctctttcaaacgtgttcttttagaccagttttctaataagctttgtaaaatgtactatccaaattagaagcggatttggaaatgcaaactaacgtgcacttagatatccaagtgggtgagcttagccactcttacccatgctctttccctggaatccctggagacctgtccaagatgatttccatataccagcatagaaaatcagaatcaagagcaaactctgagactggcacaatccaagaagatttcctggctctggcttttagtaatttgggactccaactgccactgtactggactgtaatttataaatccagtagctacgcagggtggaggctgggctgaggattaccataatgaaatgtactaaatcttcatttaggtatgcaattgtgaagtgaaggcatctgctttctttacagtatcagagtccaagaacaggatgtcaccatagataaaagcctcatacaaaggcagaactacactccaaatttaatgtgtttaaattggtggggcaccagcagaaaatacttctagctcagctttactcttcttccacactaggctgggcccagcaatacaggagaggatgaagggaggagctccaggaggcgagggaagagccctagcagggcggccatcacaaccactcactgagagttgcccttcttaaaaatgtattttattttagccagtgggtcccttcctttctcctttcctctctactgctcaagaacagatttgaggccaggtgcggtgcctcacatctgtaatcccaacactttgggaggctgagatgggtggattgcttgagcccaggagttcaagaccagcctgggcaacacagcgagaccccatctcttaaaaaataacagacttgaggaacccctctcccttccataattcccctcatccaccgcccactccaggcactcactcaaacttgctcttcaactctgtatacaagcagaagcaataaaccaatctgattttcttttcaattatttataactttcaatggttctttcctttccagctggcgagagaaaggagaactaatatacctgctggcagatttttggtgctgcccaaaaaaggacttcacagggcatctcttctcaggttcaagcctggctgaattctgcccagaagctcagtcattgcagaaatttctctaagggctgatagtacctctgggtaggcgtcacaaccaaggctggttctgggcttagtgggggctgagatgaagttacctcctccaatgagaaattgggagctgatgccctgcaacagatatatattcctctctctctctgtctctctatctctctcctccctctccctccctccctccccgccaataagccttacaaacagttttgaaatcttgttctgtaccttttaagccagtgtctgtggcgagggtgactggcaagtcagctgatgagttctgccttctgagagcactgagtgagcaaggcctttcatcagtgttttggccttctcattgggtgaggaagacattgaaccaacagccaacgagatatgaacctgtaagaaaaaagtcctagaatatagtatttttccccaggccagcaaagtgaagaaatacagtggtgacagatgagaaaggccatgttcaagagatctgaaaagtacattcctgccttatcagaaaatgtgtcagacaggttttatgtcagcctcagtgctcctgcggtgtcgacgctctgataaggaccatgttccagttagaatgcgagggagggaaagagctgcactttgcttcaccatcagaactctgagccaaataatgaatatgtaaactattttatgattattttaaatgtttgtttggtaacatttataagatctatttttatttggggatagactgagaagccaccatttacatattaacaagtgacttcagttctaagggttgagatgcctgtgtggatttataaaatggttgcaagatcttttagactctgacatttatagcatcaccttcaggaacacagttctggggatgtcatcatgagacacactgacagctgtggagatagtccctactctcagctttccttgctagtcaagtccaaaaggccttagaagctgactcaccttctcagccagagtcctgctgctcaagtgtggacctccactttgactctcacccagcctgccagccatcacaaaggctttcataaacttcctgtggtctgggctagcctggcactgatgaaattccattctaaagaaagaaaactcatattcctcccccccgcaaattgttcccccaaatgctctgggattacctatttcaccactcatttgagtctccgaaaaatgaactccctgagaatggctggatgggaatcagatagtctgcttccattcaggagagggacagaacaggagctgctgtgtttaggaggatttacctggtgccctagaaagggctatgcaatcaaattctcaagggctccttcaaatcagctatcagtcctcaaaatgggggttgctgatgttaaatgatggatttgcagtgaaacgcatgcatgtactgacgttttctttcagcattagtggttgcttaagaaaatagtaacctatattttctgctacacttggaatatgaagaaatctgaacaagaaccccattaagacacctaacctaatctaaaccctaaaattcaaaatattgtccaagtcaaaagtctagactctgaggacattaaaaatgtaaatatcatcatccttagcaaatatttattgggagcttagtaatagtgcactgggtaccttagcactcccaaatcattcaagagtctagtgaaaaagggggagggatggcagcaaataaaacacccccataaacaaccaggagcaaggttgagaaccattaagttgccaaacaaaagcagaaggggaaaaagtgtggcaacaagcatcttttaataggatagttgacggtattcaagtgacctactgactccaaataatcaaattgaacacaattgcaaatccaatagaacatcccagtgagacactcgggtatttgagaactttgcttgatttagaaaactggaaagtggcaactaggctagaatagtggcaactaggttcggaggtttcgtgtggtcataattggtttggtgaagtgtgagatctctgcaaatgagccaggtaagatcagtattccatagtgcttgaaaaggggattttagagacttctgtcatcacaaagcagattaactcctagttaatgatgaagcagtaggcccaagataaactgttcaattcaagataaattgttcttgtccagtgtttggcatatgataatcacatttggctaaaattggatgggacagtcatttgtctacacaggccttccattcctgcatgaagagatactggggagcatacaattattttggtccagtattagagtgggagaagttctcagtaagtccagtcccaccaggatttatttgggccacattctaccatggccagtccaatctgatgaccacatgaattggggttaagtgttgctaagactatgattttagacatgtctggcaggaaggtcagctcaaaatgtggcatgacaaagaatatgtgctctactaccaaaacctttcctagcaaaacaaggccagaagagggagcaagcatctttccaagcatggagaggagggggcaatggtggaagggtgattgcctgaaatcagtgccagtacagatagcataaaattgggggccaccacagattggctggctactgtgtagatcatttagtaatcttgaggtacattaataatgcagagattacttttctgtgagggtaagggggacgtagctaaatataagaagcttacaaggtccatagccatgtattttactggataaatcacaatgctttgcaataacttaatgtcatagtactttctggcttataattctgcaaagtaaagcactttttcaaaggagtctattggaaagccacatgatttcagctgtgttttaagctctacaaatacgtttccaaagacataatcaagatgtaattctattcattacaaatataaatattaaaactatccatagagacatttaagtaattaaaacagatttttatgctttaaaaataaatactctaataaatg

SEQ ID NO: 297918 - DNA, 9806 bp, Homo sapiens
  misc_feature (21)..(21): n is a, c, g, or t
  misc_feature (1961)..(1961): n is a, c, g, or t
  misc_feature (2596)..(2596): n is a, c, g, or t
ctcggtacccgactgcatccnacgtcccaaccagcacggtccccgcagaatgccagcgcacctcctcccgccacttcaaagagccggctcggcggggcaggaagcggcggctgcggctgcgggtcctgcgagaagagcgcgatttcctccggggctgcccagttatctctggagtcgcagaactgctctcgggagaacgcgttctctaccccaaccccgtgctcctcaacccacccacctacttcctctagctccacacactcacaagcaccgagctgccaaaaatttccacccaccgcccccctccctagctaacttccttccagcatttcctgagctggatgatcctaggatttgtaagacaggaaaaaaaggaaggcgtgagggcgggcagcagcgacaggatgcttgtttttcgctctaccaaagtcgtctgaaggcgagacagcgggcccagggcgcaggacccaccgcagccccctgggcagtctcctcgccccgcgtccgcgtcgtctccggggcacttagtaaggggtggggagagcttgccctccctcttaagctgaggagaaacacccgaagacaccgcaggagcctgtgaaagtccctaggactccaagtgaggaagtgacactcccaggcgagccggcccgcggctgccagtctgcacggcctcggcacggcggccccggagcggcgcggggtggatctcaggctctgccggcccgcggcccgcggggtccatgcgcagggcccccagcccaagttcttccatcttccgatgcggccccccagagccgcggggcagccggtgatctagcccgggagcccatcttacagcggtgccaagcagaggggcggcagagacggaggggcagcctctttgggactaactcatgaagaacaagggtgctaagcagaagctgaaacgaaagggagccgccagcgcgtttggctgtgacctgacggagtatctggaaagctcgggacaggatgttccatacgttttgaagagctgtgcagaatttatagagactcacggcatcgtggatggaatctatcggctttcaggagtcacctcaaacatacaacggctaaggcaagagtttggctcagatcaatgtccagatctgacaagggaagtgtacctccaggacatccactgtgtgggctcgctttgcaagctctactttagggagctgcccaaccccctcctgacttatgagctctatgagaaattcacggaggcagtgtcgcattgccctgaagaaggccaactggcccgaatccaaaatgttatccaggagcttcctccatcccactataggaccttggaatacctgattcgacacctggcccatatcgcctccttcagcagcaagaccaacatgcacgcccggaacctggccctggtgtgggcgccaaacctcctcaggtctaaagaaattgaagccactggttgcaatggagatgcagccttccttgcagtccgggtccagcaggtggtgattgagttcatattgaatcatgtagatcaaatctttaacaacggtgcacctgggtctctggagaatgatgaaaaccggcccatcatgaagagcctgaccttgccagccctctccctgcccatgaagctggtgagccttgaggaagctcaagcccgcagcctggccactaaccatcctgctcgcaaggaaaggagggagaacagcctgcctgagattgtccctcccatgggcaccctcttccacactgtccttgagttaccagacaacaagcgaaagctctccagtaaatcaaagaagtggaaatcaatatttaacctgggacgttctggatcagactccaaatcaaaactgagtagaaatgggagtgtatttgtgagaggacagaggctctcggtggaaaaggctactatccgaccagctaaaagcatggactcactatgttcagtgcctgtngaaggaaaagaaaccaagggaaatttcaatcgaacagttaccaccggtggatttttcattccagcaacaaagatgcactccaccggcaccggcagctcatgtgacctcaccaagcaggagggcgaatggggccaggaggggatgcctcccggggctgagggtggctttgatgtgagcagtgatcgcagccatctccagggcgctcaggcccggcccccaccggaacagctgaaggttttccggcctgttgaggatccggagagcgagcaaacagccccaaagatgttgggtatgttctacacttcgaacgacagccctagcaaatccgtcttcaccagcagcctcttccagatggagccctcgccgcgtaaccagcgcaaggcgctgaacatctccgagccctttgcggtatctgtgccgctccgcgtgtccgcagtcatcagcaccaacagcacgccgtgcagaacacccccgaaggagctgcagtctctttccagcctggaagagttttcttttcatggatcagagagcggaggctggccagaagaagagaaaccgctgggagctgagacttctgcagcttctgtacctaagaaggcaggtcttgaggatccaaggcagtacctgaagcaccngggacagtggaatgcagcaaaggcctgtcccaggagccaggcgcccacctggaggagaagaaaaccccagaaagctccttgagctctcaacatttaaatgaattagagaagaggccaaatccggagaaggtggtggaggagggacgagaggctggtgagatggagtccagcaccctgcaggagagccccagggccagagccgaagctgtgcttctccatgagatggatgaagatgatctggccaatgccctgatctggcctgagattcaacaggagctgaaaatcattgaatctgaggaggagctctcatcgttgccacctcctgctctgaagaccagcccaattcagcctattctcgagtcgagtctggggccctttattccctcagagcctcctgggagcttgccttgtggctccttccctgctccagtctccacccctctggaggtgtggactagggatccagccaatcagagcacacagggggcttccacagcagccagcagagagaagccggaacctgagcagggcctgcacccagacctcgccagcctggctcctctggaaatagttccttttgagaaggcatctccacaagcaacagtggaagtaggaggcccaggcaatctgtctcctccactcccacctgctcctccccctccaactcctctggaggagtcaactccagtcctgctttcaaagggcagcccggaaagagaagactcatccaggaaattgaggacagatctctacatagaccagctgaagtcccaagacagccctgagatctctagcctctgtcagggagaggaggcaaccccaagacacagtgacaagcaaaattcaaagaatgctgcttctgaggggaaaggctgtggttttccaagcccaaccagggaggttgagatcgtctcacaagaagaggaggatgtaacccattcagtacaggagccttcagactgtgacgaagatgacactgtgacagacattgcccagcatggcctggagatggtggagccctgggaggaaccccagtgggtgacgagtccccttcactctcccaccctgaaagacgcgcacaaggcccaggtacagggccttcagggtcaccagttggagaagaggctttcccacaggcccagccttcgccagagccattctctagatagcaaacccacggttaaaagccagtggactctcgaggttccctcctccagcagctgtgctaatcttgaaacagagaggaattctgaccctcttcagccccaggcacccaggagagagattactggatgggatgagaaagccctgaggtccttcagagagttctctggcctgaaaggggcagaggctcctcccaaccagaagggaccaagtggtgtgcaacccaacccagcagaaaccagccccatcagcctagcagagggaaaggagctagggacacacctggggcacagcagtccacagattaggcaaggtggtgttcctgggccagagagcagcaaggagagttcacccagcgtgcaggacagcacttcgcctggagagcaccccgcaaagttacagctaaagagcacagagtgtgggcccccaaaagggaaaaacaggccttcttccctcaacttggaccctgccattcccattgctgacctcttctggtttgagaatgtggcctcatttagttcacctggaatgcaggtctctgagccaggagacccaaaggtcacatggatgacctcatcttactgtaaagcagacccctggagggtttactcccaggacccccaggacctggacattgttgctcatgcactgacaggccgccgtaactcagctcctgtgagtgtgtcagctgtgagaacctccttcatggtcaaaatgtgccaggccagggcggtcccagtcatccctcccaagattcagtacacccagatcccacagcccctgccctctcagagctcaggggagaatggggttcagcctctggagaggagccaggagggacccagctcaaccagtgggaccactcagaaacctgccaaagatgattctccctcctccctggaaagctcaaaggaagaaaaaccaaagcaagatcccggagccattaagtcctcaccagtggatgccactgcaccctgcatgtgcgagggacctaccctttctccagaaccaggctcgtctaacctgctctccacccaggatgcagtagtgcaatgcagaaagcgcatgtcagagacagagccatctggggacaaccttctttcttcaaaactagagcgaccatctgggggttctaagcctttccacaggtcaaggccaggaagacctcagagcctaatcttattcagtcctcctttccccattatggaccacctgcccccttcatccacagtgacagattccaaggtcctgctgtcccctatcagaagtcccacccagacagtttcccctggccttctttgtggagagttggcagaaaacacatgggtcacaccagaaggggttacacttaggaataaaatgaccatccctaagaatggccagagactagagacctcaaccagctgtttttaccagcctcagcggagatcagtaattctggatggaagaagtgggaggcaaatagaatgatttcggttcacctgctggtgtctgaaaaaaaccgtgattcatctggaagttattacagggccagcttgccatattccaggcacacgttatcaagtttgggcctattgtggcctctgacttctctttcttcagccttttgaccacttattaattagtccatttgctagaagagtggtcaagggaaaaacgagagatgaaatttagttaagtctatgtgagcaagtgagagaaggttaggtaaggggagaggatggaatgcttgcctccaatgaactttggagcttgtatgtgagtcagattgctcccctattgctattatctattactcttgagagctggctgtcctttgaaagaaagaagtaatgttctttgaaagaaagaaaaatctcttgctgtgtcaaacctcaaaatgttgctattggggttagaaggcctcctctttatgctttttaatgctctttcaaacgtgttcttttagaccagttttctaataagctttgtaaaatgtactatccaaattagaagcggatttggaaatgcaaactaacgtgcacttagatatccaagtgggtgagcttagccactcttacccatgctctttccctggaatccctggagacctgtccaagatgatttccatataccagcatagaaaatcagaatcaagagcaaactctgagactggcacaatccaagaagatttcctggctctggcttttagtaatttgggactccaactgccactgtactggactgtaatttataaatccagtagctacgcagggtggaggctgggctgaggattaccataatgaaatgtactaaatcttcatttaggtatgcaattgtgaagtgaaggcatctgctttctttacagtatcagagtccaagaacaggatgtcaccatagataaaagcctcatacaaaggcagaactacactccaaatttaatgtgtttaaattggtggggcaccagcagaaaatacttctagctcagctttactcttcttccacactaggctgggcccagcaatacaggagaggatgaagggaggagctccaggaggcgagggaagagccctagcagggcggccatcacaaccactcactgagagttgcccttctactgctcaagaacagatttgaggccaggtgcggtgcctcacatctgtaatcccaacactttgggaggctgagatgggtggattgcttgagcccaggagttcaagaccagcctgggcaacacagcgagaccccatctcttaaaaaataacagacttgaggaacccctctcccttccataattcccctcatccaccgcccactccaggcactcactcaaacttgctcttcaactctgtatacaagcagaagcaataaaccaatctgattttcttttcaattatttataactttcaatggttctttcctttccagctggcgagagaaaggagaactaatatacctgctggcagatttttggtgctgcccaaaaaaggacttcacagggcatctcttctcaggttcaagcctggctgaattctgcccagaagctcagtcattgcagaaatttctctaagggctgatagtacctctgggtaggcgtcacaaccaaggctggttctgggcttagtgggggctgagatgaagttacctcctccaatgagaaattgggagctgatgccctgcaacagatatatattcctctctctctctgtctctctatctctctcctccctctccctccctccctccccgccaataagccttacaaacagttttgaaatcttgttctgtaccttttaagccagtgtctgtggcgagggtgactggcaagtcagctgatgagttctgccttctgagagcactgagtgagcaaggcctttcatcagtgttttggccttctcattgggtgaggaagacattgaaccaacagccaacgagatatgaacctgtaagaaaaaagtcctagaatatagtatttttccccaggccagcaaagtgaagaaatacagtggtgacagatgagaaaggccatgttcaagagatctgaaaagtacattcctgccttatcagaaaatgtgtcagacaggttttatgtcagcctcagtgctcctgcggtgtcgacgctctgataaggaccatgttccagttagaatgcgagggagggaaagagctgcactttgcttcaccatcagaactctgagccaaataatgaatatgtaaactattttatgattattttaaatgtttgtttggtaacatttataagatctatttttatttggggatagactgagaagccaccatttacatattaacaagtgacttcagttctaagggttgagatgcctgtgtggatttataaaatggttgcaagatcttttagactctgacatttatagcatcaccttcaggaacacagttctggggatgtcatcatgagacacactgacagctgtggagatagtccctactctcagctttccttgctagtcaagtccaaaaggccttagaagctgactcaccttctcagccagagtcctgctgctcaagtgtggacctccactttgactctcacccagcctgccagccatcacaaaggctttcataaacttcctgtggtctgggctagcctggcactgatgaaattccattctaaagaaagaaaactcatattcctcccccccgcaaattgttcccccaaatgctctgggattacctatttcaccactcatttgagtctccgaaaaatgaactccctgagaatggctggatgggaatcagatagtctgcttccattcaggagagggacagaacaggagctgctgtgtttaggaggatttacctggtgccctagaaagggctatgcaatcaaattctcaagggctccttcaaatcagctatcagtcctcaaaatgggggttgctgatgttaaatgatggatttgcagtgaaacgcatgcatgtactgacgttttctttcagcattagtggttgcttaagaaaatagtaacctatattttctgctacacttggaatatgaagaaatctgaacaagaaccccattaagacacctaacctaatctaaaccctaaaattcaaaatattgtccaagtcaaaagtctagactctgaggacattaaaaatgtaaatatcatcatccttagcaaatatttattgggagcttagtaatagtgcactgggtaccttagcactcccaaatcattcaagagtctagtgaaaaagggggagggatggcagcaaataaaacacccccataaacaaccaggagcaaggttgagaaccattaagttgccaaacaaaagcagaaggggaaaaagtgtggcaacaagcatcttttaataggatagttgacggtattcaagtgacctactgactccaaataatcaaattgaacacaattgcaaatccaatagaacatcccagtgagacactcgggtatttgagaactttgcttgatttagaaaactggaaagtggcaactaggctagaatagtggcaactaggttcggaggtttcgtgtggtcataattggtttggtgaagtgtgagatctctgcaaatgagccaggtaagatcagtattccatagtgcttgaaaaggggattttagagacttctgtcatcacaaagcagattaactcctagttaatgatgaagcagtaggcccaagataaactgttcaattcaagataaattgttcttgtccagtgtttggcatatgataatcacatttggctaaaattggatgggacagtcatttgtctacacaggccttccattcctgcatgaagagatactggggagcatacaattattttggtccagtattagagtgggagaagttctcagtaagtccagtcccaccaggatttatttgggccacattctaccatggccagtccaatctgatgaccacatgaattggggttaagtgttgctaagactatgattttagacatgtctggcaggaaggtcagctcaaaatgtggcatgacaaagaatatgtgctctactaccaaaacctttcctagcaaaacaaggccagaagagggagcaagcatctttccaagcatggagaggagggggcaatggtggaagggtgattgcctgaaatcagtgccagtacagatagcataaaattgggggccaccacagattggctggctactgtgtagatcatttagtaatcttgaggtacattaataatgcagagattacttttctgtgagggtaagggggacgtagctaaatataagaagcttacaaggtccatagccatgtattttactggataaatcacaatgctttgcaataacttaatgtcatagtactttctggcttataattctgcaaagtaaagcactttttcaaaggagtctattggaaagccacatgatttcagctgtgttttaagctctacaaatacgtttccaaagacataatcaagatgtaattctattcattacaaatataaatattaaaactatccatagagacatttaagtaattaaaacagatttttatgctttaaaaataaatactctaataaatg

SEQ ID NO: 297919 - DNA, 7061 bp, Homo sapiens
  misc_feature (21)..(21): n is a, c, g, or t
  misc_feature (1961)..(1961): n is a, c, g, or t
  misc_feature (2596)..(2596): n is a, c, g, or t
ctcggtacccgactgcatccnacgtcccaaccagcacggtccccgcagaatgccagcgcacctcctcccgccacttcaaagagccggctcggcggggcaggaagcggcggctgcggctgcgggtcctgcgagaagagcgcgatttcctccggggctgcccagttatctctggagtcgcagaactgctctcgggagaacgcgttctctaccccaaccccgtgctcctcaacccacccacctacttcctctagctccacacactcacaagcaccgagctgccaaaaatttccacccaccgcccccctccctagctaacttccttccagcatttcctgagctggatgatcctaggatttgtaagacaggaaaaaaaggaaggcgtgagggcgggcagcagcgacaggatgcttgtttttcgctctaccaaagtcgtctgaaggcgagacagcgggcccagggcgcaggacccaccgcagccccctgggcagtctcctcgccccgcgtccgcgtcgtctccggggcacttagtaaggggtggggagagcttgccctccctcttaagctgaggagaaacacccgaagacaccgcaggagcctgtgaaagtccctaggactccaagtgaggaagtgacactcccaggcgagccggcccgcggctgccagtctgcacggcctcggcacggcggccccggagcggcgcggggtggatctcaggctctgccggcccgcggcccgcggggtccatgcgcagggcccccagcccaagttcttccatcttccgatgcggccccccagagccgcggggcagccggtgatctagcccgggagcccatcttacagcggtgccaagcagaggggcggcagagacggaggggcagcctctttgggactaactcatgaagaacaagggtgctaagcagaagctgaaacgaaagggagccgccagcgcgtttggctgtgacctgacggagtatctggaaagctcgggacaggatgttccatacgttttgaagagctgtgcagaatttatagagactcacggcatcgtggatggaatctatcggctttcaggagtcacctcaaacatacaacggctaaggcaagagtttggctcagatcaatgtccagatctgacaagggaagtgtacctccaggacatccactgtgtgggctcgctttgcaagctctactttagggagctgcccaaccccctcctgacttatgagctctatgagaaattcacggaggcagtgtcgcattgccctgaagaaggccaactggcccgaatccaaaatgttatccaggagcttcctccatcccactataggaccttggaatacctgattcgacacctggcccatatcgcctccttcagcagcaagaccaacatgcacgcccggaacctggccctggtgtgggcgccaaacctcctcaggtctaaagaaattgaagccactggttgcaatggagatgcagccttccttgcagtccgggtccagcaggtggtgattgagttcatattgaatcatgtagatcaaatctttaacaacggtgcacctgggtctctggagaatgatgaaaaccggcccatcatgaagagcctgaccttgccagccctctccctgcccatgaagctggtgagccttgaggaagctcaagcccgcagcctggccactaaccatcctgctcgcaaggaaaggagggagaacagcctgcctgagattgtccctcccatgggcaccctcttccacactgtccttgagttaccagacaacaagcgaaagctctccagtaaatcaaagaagtggaaatcaatatttaacctgggacgttctggatcagactccaaatcaaaactgagtagaaatgggagtgtatttgtgagaggacagaggctctcggtggaaaaggctactatccgaccagctaaaagcatggactcactatgttcagtgcctgtngaaggaaaagaaaccaagggaaatttcaatcgaacagttaccaccggtggatttttcattccagcaacaaagatgcactccaccggcaccggcagctcatgtgacctcaccaagcaggagggcgaatggggccaggaggggatgcctcccggggctgagggtggctttgatgtgagcagtgatcgcagccatctccagggcgctcaggcccggcccccaccggaacagctgaaggttttccggcctgttgaggatccggagagcgagcaaacagccccaaagatgttgggtatgttctacacttcgaacgacagccctagcaaatccgtcttcaccagcagcctcttccagatggagccctcgccgcgtaaccagcgcaaggcgctgaacatctccgagccctttgcggtatctgtgccgctccgcgtgtccgcagtcatcagcaccaacagcacgccgtgcagaacacccccgaaggagctgcagtctctttccagcctggaagagttttcttttcatggatcagagagcggaggctggccagaagaagagaaaccgctgggagctgagacttctgcagcttctgtacctaagaaggcaggtcttgaggatccaaggcagtacctgaagcaccngggacagtggaatgcagcaaaggcctgtcccaggagccaggcgcccacctggaggagaagaaaaccccagaaagctccttgagctctcaacatttaaatgaattagagaagaggccaaatccggagaaggtggtggaggagggacgagaggctggtgagatggagtccagcaccctgcaggagagccccagggccagagccgaagctgtgcttctccatgagatggatgaagatgatctggccaatgccctgatctggcctgagattcaacaggagctgaaaatcattgaatctgaggaggagctctcatcgttgccacctcctgctctgaagaccagcccaattcagcctattctcgagtcgagtctggggccctttattccctcagagcctcctgggagcttgccttgtggctccttccctgctccagtctccacccctctggaggtgtggactagggatccagccaatcagagcacacagggggcttccacagcagccagcagagagaagccggaacctgagcagggcctgcacccagacctcgccagcctggctcctctggaaatagttccttttgagaaggcatctccacaagcaacagtggaagtaggaggcccaggcaatctgtctcctccactcccacctgctcctccccctccaactcctctggaggagtcaactccagtcctgctttcaaagggcagcccggaaagagaagactcatccaggaaattgaggacagatctctacatagaccagctgaagtcccaagacagccctgagatctctagcctctgtcagggagaggaggcaaccccaagacacagtgacaagcaaaattcaaagaatgctgcttctgaggggaaaggctgtggttttccaagcccaaccagggaggttgagatcgtctcacaagaagaggaggatgtaacccattcagtacaggagccttcagactgtgacgaagatgacactgtgacagacattgcccagcatggcctggagatggtggagccctgggaggaaccccagtgggtgacgagtccccttcactctcccaccctgaaagacgcgcacaaggcccaggtacagggccttcagggtcaccagttggagaagaggctttcccacaggcccagccttcgccagagccattctctagatagcaaacccacggttaaaagccagtggactctcgaggttccctcctccagcagctgtgctaatcttgaaacagagaggaattctgaccctcttcagccccaggcacccaggagagagattactggatgggatgagaaagccctgaggtccttcagagagttctctggcctgaaaggggcagaggctcctcccaaccagaagggaccaagtggtgtgcaacccaacccagcagaaaccagccccatcagcctagcagagggaaaggagctagggacacacctggggcacagcagtccacagattaggcaaggtggtgttcctgggccagagagcagcaaggagagttcacccagcgtgcaggacagcacttcgcctggagagcaccccgcaaagttacagctaaagagcacagagtgtgggcccccaaaagggaaaaacaggccttcttccctcaacttggaccctgccattcccattgctgacctcttctggtttgagaatgtggcctcatttagttcacctggaatgcaggtctctgagccaggagacccaaaggtcacatggatgacctcatcttactgtaaagcagacccctggagggtttactcccaggacccccaggacctggacattgttgctcatgcactgacaggccgccgtaactcagctcctgtgagtgtgtcagctgtgagaacctccttcatggtcaaaatgtgccaggccagggcggtcccagtcatccctcccaagattcagtacacccagatcccacagcccctgccctctcagagctcaggggagaatggggttcagcctctggagaggagccaggagggacccagctcaaccagtgggaccactcagaaacctgccaaagatgattctccctcctccctggaaagctcaaaggaagaaaaaccaaagcaagatcccggagccattaagtcctcaccagtggatgccactgcaccctgcatgtgcgagggacctaccctttctccagaaccaggctcgtctaacctgctctccacccaggatgcagtagtgcaatgcagaaagcgcatgtcagagacagagccatctggggacaaccttctttcttcaaaactagagcgaccatctgggggttctaagcctttccacaggtcaaggccaggaagacctcagagcctaatcttattcagtcctcctttccccattatggaccacctgcccccttcatccacagtgacagattccaaggtcctgctgtcccctatcagaagtcccacccagacagtttcccctggccttctttgtggagagttggcagaaaacacatgggtcacaccagaaggggttacacttaggaataaaatgaccatccctaagaatggccagagactagagacctcaaccagctgtttttaccagcctcagcggagatcagtaattctggatggaagaagtgggaggcaaatagaatgatttcggttcacctgctggtgtctgaaaaaaaccgtgattcatctggaagttattacagggccagcttgccatattccaggcacacgttatcaagtttgggcctattgtggcctctgacttctctttcttcagccttttgaccacttattaattagtccatttgctagaagagtggtcaagggaaaaacgagagatgaaatttagttaagtctatgtgagcaagtgagagaaggttaggtaaggggagaggatggaatgcttgcctccaatgaactttggagcttgtatgtgagtcagattgctcccctattgctattatctattactcttgagagctggctgtcctttgaaagaaagaagtaatgttctttgaaagaaagaaaaatctcttgctgtgtcaaacctcaaaatgttgctattggggttagaaggcctcctctttatgctttttaatgctctttcaaacgtgttcttttagaccagttttctaataagctttgtaaaatgtactatccaaattagaagcggatttggaaatgcaaactaacgtgcacttagatatccaagtgggtgagcttagccactcttacccatgctctttccctggaatccctggagacctgtccaagatgatttccatataccagcatagaaaatcagaatcaagagcaaactctgagactggcacaatccaagaagatttcctggctctggcttttagtaatttgggactccaactgccactgtactggactgtaatttataaatccagtagctacgcagggtggaggctgggctgaggattaccataatgaaatgtactaaatcttcatttaggtatgcaattgtgaagtgaaggcatctgctttctttacagtatcagagtccaagaacaggatgtcaccatagataaaagcctcatacaaaggcagaactacactccaaatttaatgtgtttaaattggtggggcaccagcagaaaatacttctagctcagctttactcttcttccacactaggctgggcccagcaatacaggagaggatgaagggaggagctccaggaggcgagggaagagccctagcagggcggccatcacaaccactcactgagagttgcccttcttaaaaatgtattttattttagccagtgggtcccttcctttctcctttcctctctactgctcaagaacagatttgaggccaggtgcggtgcctcacatctgtaatcccaacactttgggaggctgagatgggtggattgcttgagcccaggagttcaagaccagcctgggcaacacagcgagaccccatctcttaaaaaataacagacttgaggaacccctctcccttccataattcccctcatccaccgcccactccaggcactcactcaaacttgctcttcaactctgtatacaagcagaagcaataaaccaatctgattttcttttcaattaaaaaaaaaaaacaaaaaaaacaagaaaaaaaaaaaccaaaaagaaaaacaaaaaaacaacagaagtcaaacaacacgaaaaaacaaagaaagcaggagagggaggagcgcgaccgacccacagaagcacacaccacgagggagcaaaaaaaaaaaaaaaaaacaaaaactacacaaacaacagtcacacaaacgcggcgcggcgtcagaagctgatcaccggcgcacgggacgcaacaccgatccatccgccacacactgaaagcgggcgccctggaaggcaacacactatccggcggccccgcgccaaacacaccccggaggagaaccctccgcgcgacagcacaccccccctgtcggcgccagccggcgc

SEQ ID NO: 297920 - DNA, 5212 bp, Homo sapiens
  misc_feature (21)..(21): n is a, c, g, or t
  misc_feature (1961)..(1961): n is a, c, g, or t
  misc_feature (2596)..(2596): n is a, c, g, or t
ctcggtacccgactgcatccnacgtcccaaccagcacggtccccgcagaatgccagcgcacctcctcccgccacttcaaagagccggctcggcggggcaggaagcggcggctgcggctgcgggtcctgcgagaagagcgcgatttcctccggggctgcccagttatctctggagtcgcagaactgctctcgggagaacgcgttctctaccccaaccccgtgctcctcaacccacccacctacttcctctagctccacacactcacaagcaccgagctgccaaaaatttccacccaccgcccccctccctagctaacttccttccagcatttcctgagctggatgatcctaggatttgtaagacaggaaaaaaaggaaggcgtgagggcgggcagcagcgacaggatgcttgtttttcgctctaccaaagtcgtctgaaggcgagacagcgggcccagggcgcaggacccaccgcagccccctgggcagtctcctcgccccgcgtccgcgtcgtctccggggcacttagtaaggggtggggagagcttgccctccctcttaagctgaggagaaacacccgaagacaccgcaggagcctgtgaaagtccctaggactccaagtgaggaagtgacactcccaggcgagccggcccgcggctgccagtctgcacggcctcggcacggcggccccggagcggcgcggggtggatctcaggctctgccggcccgcggcccgcggggtccatgcgcagggcccccagcccaagttcttccatcttccgatgcggccccccagagccgcggggcagccggtgatctagcccgggagcccatcttacagcggtgccaagcagaggggcggcagagacggaggggcagcctctttgggactaactcatgaagaacaagggtgctaagcagaagctgaaacgaaagggagccgccagcgcgtttggctgtgacctgacggagtatctggaaagctcgggacaggatgttccatacgttttgaagagctgtgcagaatttatagagactcacggcatcgtggatggaatctatcggctttcaggagtcacctcaaacatacaacggctaaggcaagagtttggctcagatcaatgtccagatctgacaagggaagtgtacctccaggacatccactgtgtgggctcgctttgcaagctctactttagggagctgcccaaccccctcctgacttatgagctctatgagaaattcacggaggcagtgtcgcattgccctgaagaaggccaactggcccgaatccaaaatgttatccaggagcttcctccatcccactataggaccttggaatacctgattcgacacctggcccatatcgcctccttcagcagcaagaccaacatgcacgcccggaacctggccctggtgtgggcgccaaacctcctcaggtctaaagaaattgaagccactggttgcaatggagatgcagccttccttgcagtccgggtccagcaggtggtgattgagttcatattgaatcatgtagatcaaatctttaacaacggtgcacctgggtctctggagaatgatgaaaaccggcccatcatgaagagcctgaccttgccagccctctccctgcccatgaagctggtgagccttgaggaagctcaagcccgcagcctggccactaaccatcctgctcgcaaggaaaggagggagaacagcctgcctgagattgtccctcccatgggcaccctcttccacactgtccttgagttaccagacaacaagcgaaagctctccagtaaatcaaagaagtggaaatcaatatttaacctgggacgttctggatcagactccaaatcaaaactgagtagaaatgggagtgtatttgtgagaggacagaggctctcggtggaaaaggctactatccgaccagctaaaagcatggactcactatgttcagtgcctgtngaaggaaaagaaaccaagggaaatttcaatcgaacagttaccaccggtggatttttcattccagcaacaaagatgcactccaccggcaccggcagctcatgtgacctcaccaagcaggagggcgaatggggccaggaggggatgcctcccggggctgagggtggctttgatgtgagcagtgatcgcagccatctccagggcgctcaggcccggcccccaccggaacagctgaaggttttccggcctgttgaggatccggagagcgagcaaacagccccaaagatgttgggtatgttctacacttcgaacgacagccctagcaaatccgtcttcaccagcagcctcttccagatggagccctcgccgcgtaaccagcgcaaggcgctgaacatctccgagccctttgcggtatctgtgccgctccgcgtgtccgcagtcatcagcaccaacagcacgccgtgcagaacacccccgaaggagctgcagtctctttccagcctggaagagttttcttttcatggatcagagagcggaggctggccagaagaagagaaaccgctgggagctgagacttctgcagcttctgtacctaagaaggcaggtcttgaggatccaaggcagtacctgaagcaccngggacagtggaatgcagcaaaggcctgtcccaggagccaggcgcccacctggaggagaagaaaaccccagaaagctccttgagctctcaacatttaaatgaattagagaagaggccaaatccggagaaggtggtggaggagggacgagaggctggtgagatggagtccagcaccctgcaggagagccccagggccagagccgaagctgtgcttctccatgagatggatgaagatgatctggccaatgccctgatctggcctgagattcaacaggagctgaaaatcattgaatctgaggaggagctctcatcgttgccacctcctgctctgaagaccagcccaattcagcctattctcgagtcgagtctggggccctttattccctcagagcctcctgggagcttgccttgtggctccttccctgctccagtctccacccctctggaggtgtggactagggatccagccaatcagagcacacagggggcttccacagcagccagcagagagaagccggaacctgagcagggcctgcacccagacctcgccagcctggctcctctggaaatagttccttttgagaaggcatctccacaagcaacagtggaagtaggaggcccaggcaatctgtctcctccactcccacctgctcctccccctccaactcctctggaggagtcaactccagtcctgctttcaaagggcagcccggaaagagaagactcatccaggaaattgaggacagatctctacatagaccagctgaagtcccaagacagccctgagatctctagcctctgtcagggagaggaggcaaccccaagacacagtgacaagcaaaattcaaagaatgctgcttctgaggggaaaggctgtggttttccaagcccaaccagggaggttgagatcgtctcacaagaagaggaggatgtaacccattcagtacaggagccttcagactgtgacgaagatgacactgtgacagacattgcccagcatggcctggagatggtggagccctgggaggaaccccagtgggtgacgagtccccttcactctcccaccctgaaagacgcgcacaaggcccaggtacagggccttcagggtcaccagttggagaagaggctttcccacaggcccagccttcgccagagccattctctagatagcaaacccacggttaaaagccagtggactctcgaggttccctcctccagcagctgtgctaatcttgaaacagagaggaattctgaccctcttcagccccaggcacccaggagagagattactggatgggatgagaaagccctgaggtccttcagagagttctctggcctgaaaggggcagaggctcctcccaaccagaagggaccaagtggtgtgcaacccaacccagcagaaaccagccccatcagcctagcagagggaaaggagctagggacacacctggggcacagcagtccacagattaggcaaggtggtgttcctgggccagagagcagcaaggagagttcacccagcgtgcaggacagcacttcgcctggagagcaccccgcaaagttacagctaaagagcacagagtgtgggcccccaaaagggaaaaacaggccttcttccctcaacttggaccctgccattcccattgctgacctcttctggtttgagaatgtggcctcatttagttcacctggaatgcaggtctctgagccaggagacccaaaggtcacatggatgacctcatcttactgtaaagcagacccctggagggtttactcccaggacccccaggacctggacattgttgctcatgcactgacaggccgccgtaactcagctcctgtgagtgtgtcagctgtgagaacctccttcatggtcaaaatgtgccaggccagggcggtcccagtcatccctcccaagattcagtacacccagatcccacagcccctgccctctcagagctcaggggagaatggggttcagcctctggagaggagccaggagggacccagctcaaccagtgggaccactcagaaacctgccaaagatgattctccctcctccctggaaagctcaaaggaagaaaaaccaaagcaagatcccggagccattaagtcctcaccagtggatgccactgcaccctgcatgtgcgagggacctaccctttctccagaaccaggctcgtctaacctgctctccacccaggatgcagtagtgcaatgcagaaagcgcatgtcagagacagagccatctggggacaaccttctttcttcaaaactagagcgaccatctgggggttctaagcctttccacaggtcaaggccaggaagacctcagagcctaatcttattcagtcctcctttccccattatggaccacctgcccccttcatccacagtgacagattccaaggtcctgctgtcccctatcagaagtcccacccagacagtttcccctggccttctttgtggagagttggcagaaaacacatgggtcacaccagaaggggttacacttaggaataaaatgaccatccctaagaatggccagtgtggagagagagtgtgtggagagagccagtgtggagagagagtgtggagagagccagtgtgaagagag

SEQ ID NO: 297921 - DNA, 520 bp, Homo sapiens
aataaaaaaggaattatgccttttataaaagaaaaacttttataaaaggcataattttataaagagccacaattctgttacttcccactcttccattaatttattaaatttttggtcactcttgctattaaatttcctgatgtaaaccttgatatggaggagactattcttgcagtaaatctgctaacatatttggaaataagtacatttgaaaaaagaaactttacatttgctttaatcagagctttttctacaacaaaacaagataaaattatttccttcatctttgcacttacgatcccaaagatgatgtttcttccaaatgaatgtttgcattttattttccagacttgttctctaaaaccaattattgctccattaagaaacatttttacatcttcttcaggaatgtcgttgtctgctgggtcttcccctcttcattcccccaagattactccacatacttctcctgctcccagaagaagaagtcacactccaaatccagcaagttacatggtgc

SEQ ID NO: 297922 - DNA, 371 bp, Homo sapiens
acagggtcttgctctgtcatccaggctggagggtactggtgtagagatggctcactgcagccttcacctcctgggctcaagcagttctcctgaatagctgggaccacagacaccaaatcctactgcaagcgagtttattcctaaaggaggatcaacctccaggctgagtaacgtgtcccagtcaaatatgtctgccttctctcaagttttctctcacccatccatgggaagccctgctactgctggattagcgccaggaatgtcgttgtctgctgggtcttcccctcttcattcccccaagattactccacatacttctcctgctcccagaagaagaagtcacactccaaatccagcaagttacatggtgc

SEQ ID NO: 297923 - DNA, 382 bp, Homo sapiens
tactactactaaattcgcggccgcgtcgactagaattgtgcaggctggatgagataatgacatactcttttacactgtaacagcagcattattgcctagaactttaaccattttagagttagatactaaggaaacaaactaattggtcatcatcattttctttttttctttttcttttttttttttttgcccttatgtgtcactaaacaactagtttctctcccttttgtcagttcccattgtgtattttttcaaaagaagtactgtattcggatgccagctaataaattgtcacacaatggaaaatcatatgccacaacattcattgtaaggtttaataaaattaaatttgcaccaaaaaaaagtcgacgcggccgcgaat

SEQ ID NO: 297924 - DNA, 5903 bp, Homo sapiens
caccccggccgcgacgccccgccccgcgcctaggctgttgctggccgcggccgccgccctcccccggcccaatggcgtggcggcacagtcagtgatgtgacgctcaggcttgtccggcccccggctcgcagcccattacaccatccgtcgcagcagtcgctgcagccgctgcagtccgagccgactaagggcgggaggcagctcgggtggcggggcgtggcgaacagcgcggccggattcattcctttggggcgcggagcatggaggagctgtgcggccgcaggcggagcagggcggcccgggcggcggtggggacaacggtttccctttgaaggggacggacaaagcccgagtgaccagcggcggcggggaggactagtccccgggcagtttggtgccctggttgtcagatgttggaaagcagtaggacggaacatactcttcgtggttgtgtatccgttctggggtgcagcaattaacattggactttggttcctgtgactcttgcctgtgtcgatagagttaaactggagctctgctttgaaagataaataaagcacagcctctcaactggacataaatggatctaaagacagcagtatttaacgcagctcgggatggcaaactccggcttctcaccaaattgttggcaagcaaatccaaagaggaggtttcctccttgatctctgaaaaaacaaatggggccacgccactcttgatggccgccaggtatgggcaccttgacatggtggaattcctcctagagcaatgcagtgcctccatagaagttgggggctccgtcaattttgatggcgaaaccattgagggggctccccctttatgggccgcttctgcagcaggacatctgaaggtggtccagtccttgttaaatcatggagcatctgtcaacaacacgactttaaccaattcaactcctcttcgagctgcgtgtttcgatggccatttggaaatagtgaagtaccttgtagaacacaaagctgatttggaagtgtcaaaccgacatgggcatacgtgcttgatgatttcatgttacaaaggacataaagagattgctcagtatttacttgaaaagggggcagatgttaatagaaaaagtgtcaaaggtaatactgcattgcatgattgtgcagaatctggaagtttggacatcatgaagatgcttcttatgtattgtgccaagatggaaaaggatggttatggaatgactccccttctctcagcaagtgtgactggtcacacaaatattgtggattttctgacacaccatgcacagaccagcaagacagaacgtattaatgctctagagcttctgggagctacatttgtagacaaaaaaagagatctgcttggggctttgaaatactggaaaaaggcaatgaacatgaggtacagtgataggactaatattattagtaaaccagtgccacagacactaataatggcttatgattatgccaaggaagtgaacagtgcagaagagctagaaggtcttattgctgatcctgatgagatgagaatgcaggcactattaatcagagaacgtattcttggtccttctcatcctgatacctcttactatattagatatagaggcgctgtctatgcagactctggaaatttcaaacgatgcatcaacctatggaagtatgctttggatatgcagcagagcaatttggatcctttaagcccaatgaccgccagcagcttattatcttttgcagaactattctcctttatgctacaggatagggctaaaggcctgctgggtactactgttacatttgatgatcttatgggcatactttgcaaaagcgtccttgaaatagagcgagctatcaaacaaactcagtgtccagctgacccattacagttaaataaggccctttctattattttgcacttaatttgcttgttagagaaagttccttgtactctagaacaagaccatttcaaaaagcagactatatacaggtttcttaagctgcatccaaggggaaagaataacttcagccctcttcatctggctgtggacaagaatactacatgtgtagggcggtaccctgtttgtaaatttccatctctacaagttactgcaatactgatagaatgtggtgctgatgtgaacgtcagagactcggatgacaacagtcccctgcatatcgctgctcttaacaaccatccagacatcatgaatctccttattaaatcaggtgcacattttgatgccacaaacttgcacaaacaaactgctagtgacttgctggatgagaaggaaatagctaaaaatttaatccagcctataaatcataccacattgcagtgtcttgctgctcgtgtcatagtgaatcatagaatatattataaagggcatatcccagaaaagctagagacttttgtttcccttcatagatgataacttgactgtattttagcactgttaaagcacgaattggtaacagttgtttcataaatgagcactgttgtgataacaccagcattcatttagcttgattgatatcattgtgctctcattggctaaagcattataagcatcaaatttacaacattggtttcccaatatttaatataaatataccatataatatattgtttgtgaattattgagaaatgtaacattcaaatttctaaaattgtctgccaaaggcttattcattctggttttgtttgctgttgggtgtttggggcagagttaaccatttctccatggtgtctttatactttactggtttgtgaattttatacaattgaaagtctttttttcttgcttctttcttctcttctcaagtttcccccctgtttctactttattgtttgtcctaaccatttctactacagttttttccttatggacccatactaggttgtacaaaccttaaggactcgttaccatttgcagttaccataagtgctttatcttctctatgcacaggcttaaacttgactgttgtatgttagcatattttctatgcagcagttggtcaacttcaactcaaaacactgttttcttatgtttgttacaaacttaattttttgaaagtactctgtagcatgacaatttttagagctgcaggttagctattatagctcaagcttttttgtttgtttttttcttcactttcttcacatctgaggtttctttctctaatccactgaaattattgtgtgctaaatttgggaaacagatctattctaactcattaacccagttgaaatttaggtctgtcatcttaatatatcatgcagtaaaaggaagaatctttttaaagtgacccacctttcatgctgctccagcattgtcctgcttgtgctgatggtgtgattaggtgtagagaatttgcttaaatttaacttcaaagttcatcacacagcttaatgagtcacattgaaatactcagtaattgaactgcaaatcacttttagttacaaaaagagctaaagcatgtcagtggcatgatgcttgccaagccagatctaggcatctaggataattaaggtattttagtatgcaatttactgccataatatcaaaggtcagtaacagtgttctttctttcttcaagcttatgtatacctttaaagataacttgcatgaattactttgattactttggtctcaattatttgtcaccccagttaaacatgaaaggttgcagtgcttcctgttcccttactggaagttagctttttcttttctctttcttcctttctttctctcactctttctttctctttctctttctctctctctctctctctcactcactcactcacagatttgctaatgccacagaaagggctcttttaacttaagataagtgaaaagtactaaaaaagattcaggtaattatcattcagcactttattgtaattcagaataaaatttatgatggcatatttgccctgcaaatgtcttaatgaagttgttctcaataaaaagctccttattgatttgagaaaaaatcagtttacctgtgagttcaatgagctggatcactcacttggatttttgtgttgacattttattctgagggttgatgttacactatttaaggagtcatcaatgcaaacagtcacattaggtatgtcatcatctttagtcagtaaaaaccttgtaatgaggagtagtaaataaacaagagaacattagactttttggttaaataattgagatttaatttttaaaagatattcttactcatttgctaggttgtaaatttgatttcaccattaagaaaaggtaaattggatataaatgaacgatctccaactttttgatgaagaggttttactatctctcactgtgggaaaatttgatgaaatatttgaactgtcacatatattaagaatactttatgatttagaccaatattctagaaatatcaaatgtcagtatcttgaaatcatctgcctctaactttgtggtataagaattatatatgaataagctattatttttataaaggaaaactttgccattatagtaaattacattagttgatctcgataatttgaggataacagatgacaattgaatttttaattgatttagtatttcctcctcctctttgggggctgggtgggagggcttacatgctcttatagtgaggcacatctcactgttttgcagcagaatttgaattgtgcaactcctgtgtaaagtaaggatttctttaaatagcatttttgcaccagtaaaaatagataacttagaactcagtcttgataactgaaatgacttatttcacttagaatacatttctcccttctctgccatctccacaaatgccattgggaggttttgaaaaaccagttaatttaatagctcaaaattgtccctgattttattttcttttagggaaaattgtttcataaatgtgacactgataaagcctttgtcagaaagtattctcacaattatgagatggattataataaaatacttaaatttgtgttattttttgaaccacagatgagtaaatttaataatgaaccaattacactcttgagtctaactaaactgtacactgtagcacggtgttattgactggagttaatgtgtaagttattaacatttctatgaaaatgcccttttggggcctcctgaattttagatgttccactgttttgatcatttctataaaagaaatggtcattttacttagatgccagtctactttataaagacaaatggattatagacttaaaaatagtcatttttcttattcataaatctgacaggcataaacccaaatcaaagataatttggtgcccattatgaatttgaagttaagtgatagctcacttgtaaagtgactaccttaatgtgtatagagaccccagtctactattatttgggaaaattgtttaggttatatgggaaaagtagctctttaaaaatcatattgcccaacagaaaccttaggctgaatttacaggtatgataatttttgtaattaattttcttagaattgtgcaggctggatgagataatgacatactcttttacactgtaacagcagcattattgcctagaactttaaccattttagagttagatactaaggaaacaaactaattggtcatcatcattttctttttttctttttcttttttttttttttgcccttatgtgtcactaaacaactagtttctctcccttttgtcagttcccattgtgtattttttcaaaagaagtactgtattcggatgccagctaataaattgtcacacaatggaaaatcatatgccacaacattcattgtaaggtttaataaaattaaatttttgccccaaaagaaaaaaaaaaacttagaaacagaagatagatcaagagaacaaaataagctaaataccaagcgagg

SEQ ID NO: 297925 - DNA, 3997 bp, Homo sapiens
caccccggccgcgacgccccgccccgcgcctaggctgttgctggccgcggccgccgccctcccccggcccaatggcgtggcggcacagtcagtgatgtgacgctcaggcttgtccggcccccggctcgcagcccattacaccatccgtcgcagcagtcgctgcagccgctgcagtccgagccgactaagggcgggaggcagctcgggtggcggggcgtggcgaacagcgcggccggattcattcctttggggcgcggagcatggaggagctgtgcggccgcaggcggagcagggcggcccgggcggcggtggggacaacggtttccctttgaaggggacggacaaagcccgagtgaccagcggcggcggggaggactagtccccgggcagtttggtgccctggttgtcagatgttggaaagcagtaggacggaacatactcttcgtggttgtgtatccgttctggggtgcagcaattaacattggactttggttcctgtgactcttgcctgtgtcgatagagttaaactggagctctgctttgaaagataaataaagcacagcctctcaactggacataaatggatctaaagacagcagtatttaacgcagctcgggatggcaaactccggcttctcaccaaattgttggcaagcaaatccaaagaggaggtttcctccttgatctctgaaaaaacaaatggggccacgccactcttgatggccgccaggtatgggcaccttgacatggtggaattcctcctagagcaatgcagtgcctccatagaagttgggggctccgtcaattttgatggcgaaaccattgagggggctccccctttatgggccgcttctgcagcaggacatctgaaggtggtccagtccttgttaaatcatggagcatctgtcaacaacacgactttaaccaattcaactcctcttcgagctgcgtgtttcgatggccatttggaaatagtgaagtaccttgtagaacacaaagctgatttggaagtgtcaaaccgacatgggcatacgtgcttgatgatttcatgttacaaaggacataaagagattgctcagtatttacttgaaaagggggcagatgttaatagaaaaagtgtcaaaggtaatactgcattgcatgattgtgcagaatctggaagtttggacatcatgaagatgcttcttatgtattgtgccaagatggaaaaggatggttatggaatgactccccttctctcagcaagtgtgactggtcacacaaatattgtggattttctgacacaccatgcacagaccagcaagacagaacgtattaatgctctagagcttctgggagctacatttgtagacaaaaaaagagatctgcttggggctttgaaatactggaaaaaggcaatgaacatgaggtacagtgataggactaatattattagtaaaccagtgccacagacactaataatggcttatgattatgccaaggaagtgaacagtgcagaagagctagaaggtcttattgctgatcctgatgagatgagaatgcaggcactattaatcagagaacgtattcttggtccttctcatcctgatacctcttactatattagatatagaggcgctgtctatgcagactctggaaatttcaaacgatgcatcaacctatggaagtatgctttggatatgcagcagagcaatttggatcctttaagcccaatgaccgccagcagcttattatcttttgcagaactattctcctttatgctacaggatagggctaaaggcctgctgggtactactgttacatttgatgatcttatgggcatactttgcaaaagcgtccttgaaatagagcgagctatcaaacaaactcagtgtccagctgacccattacagttaaataaggccctttctattattttgcacttaatttgcttgttagagaaagttccttgtactctagaacaagaccatttcaaaaagcagactatatacaggtttcttaagctgcatccaaggggaaagaataacttcagccctcttcatctggctgtggacaagaatactacatgtgtagggcggtaccctgtttgtaaatttccatctctacaagttactgcaatactgatagaatgtggtgctgatgtgaacgtcagagactcggatgacaacagtcccctgcatatcgctgctcttaacaaccatccagacatcatgaatctccttattaaatcaggtgcacattttgatgccacaaacttgcacaaacaaactgctagtgacttgctggatgagaaggaaatagctaaaaatttaatccagcctataaatcataccacattgcagtgtcttgctgctcgtgtcatagtgaatcatagaatatattataaagggcatatcccagaaaagctagagacttttgtttcccttcatagatgataacttgactgtattttagcactgttaaagcacgaattggtaacagttgtttcataaatgagcactgttgtgataacaccagcattcatttagcttgattgatatcattgtgctctcattggctaaagcattataagcatcaaatttacaacattggtttcccaatatttaatataaatataccatataatatattgtttgtgaattattgagaaatgtaacattcaaatttctaaaattgtctgccaaaggcttattcattctggttttgtttgctgttgggtgtttggggcagagttaaccatttctccatggtgtctttatactttactggtttgtgaattttatacaattgaaagtctttttttcttgcttctttcttctcttctcaagtttcccccctgtttctactttattgtttgtcctaaccatttctactacagttttttccttatggacccatactaggttgtacaaaccttaaggactcgttaccatttgcagttaccataagtgctttatcttctctatgcacaggcttaaacttgactgttgtatgttagcatattttctatgcagcagttggtcaacttcaactcaaaacactgttttcttatgtttgttacaaacttaattttttgaaagtactctgtagcatgacaatttttagagctgcaggttagctattatagctcaagcttttttgtttgtttttttcttcactttcttcacatctgaggtttctttctctaatccactgaaattattgtgtgctaaatttgggaaacagatctattctaactcattaacccagttgaaatttaggtctgtcatcttaatatatcatgcagtaaaaggaagaatctttttaaagtgacccacctttcatgctgctccagcattgtcctgcttgtgctgatggtgtgattaggtgtagagaatttgcttaaatttaacttcaaagttcatcacacagcttaatgagtcacattgaaatactcagtaattgaactgcaaatcacttttagttacaaaaagagctaaagcatgtcagtggcatgatgcttgccaagccagatctaggcatctaggataattaaggtattttagtatgcaatttactgccataatatcaaaggtcagtaacagtgttctttctttcttcaagcttatgtatacctttaaagataacttgcatgaattactttgattactttggtctcaattatttgtcaccccagttaaacatgaaaggttgcagtgcttcctgttcccttactggaagttagctttttcttttctctttcttcctttctttctctcactctttctttctctttctctttctctctctctctctctctcactcactcactcacagatttgctaatgccacagaaagggctcttttaacttaagataagtgaaaagtactaaaaaagattcaggtaattatcattcagcactttattgtaattcagaataaaatttatgatggcatatttgccctgcaaatgtcttaatgaagttgttctcaataaaaagctccttattgatttgaga

SEQ ID NO: 297926 - DNA, 5857 bp, Homo sapiens
caccccggccgcgacgccccgccccgcgcctaggctgttgctggccgcggccgccgccctcccccggcccaatggcgtggcggcacagtcagtgatgtgacgctcaggcttgtccggcccccggctcgcagcccattacaccatccgtcgcagcagtcgctgcagccgctgcagtccgagccgactaagggcgggaggcagctcgggtggcggggcgtggcgaacagcgcggccggattcattcctttggggcgcggagcatggaggagctgtgcggccgcaggcggagcagggcggcccgggcggcggtggggacaacggtttccctttgaaggggacggacaaagcccgagtgaccagcggcggcggggaggactagtccccgggcagtttggtgccctggttgtcagatgttggaaagcagtaggacggaacatactcttcgtggttgtgtatccgttctggggtgcagcaattaacattggactttggttcctgtgactcttgcctgtgtcgatagagttaaactggagctctgctttgaaagataaataaagcacagcctctcaactggacataaatggatctaaagacagcagtatttaacgcagctcgggatggcaaactccggcttctcaccaaattgttggcaagcaaatccaaagaggaggtttcctccttgatctctgaaaaaacaaatggggccacgccactcttgatggccgccaggtatgggcaccttgacatggtggaattcctcctagagcaatgcagtgcctccatagaagttgggggctccgtcaattttgatggcgaaaccattgagggggctccccctttatgggccgcttctgcagcaggacatctgaaggtggtccagtccttgttaaatcatggagcatctgtcaacaacacgactttaaccaattcaactcctcttcgagctgcgtgtttcgatggccatttggaaatagtgaagtaccttgtagaacacaaagctgatttggaagtgtcaaaccgacatgggcatacgtgcttgatgatttcatgttacaaaggacataaagagattgctcagtatttacttgaaaagggggcagatgttaatagaaaaagtgtcaaaggtaatactgcattgcatgattgtgcagaatctggaagtttggacatcatgaagatgcttcttatgtattgtgccaagatggaaaaggatggttatggaatgactccccttctctcagcaagtgtgactggtcacacaaatattgtggattttctgacacaccatgcacagaccagcaagacagaacgtattaatgctctagagcttctgggagctacatttgtagacaaaaaaagagatctgcttggggctttgaaatactggaaaaaggcaatgaacatgaggtacagtgataggactaatattattagtaaaccagtgccacagacactaataatggcttatgattatgccaaggaagtgaacagtgcagaagagctagaaggtcttattgctgatcctgatgagatgagaatgcaggcactattaatcagagaacgtattcttggtccttctcatcctgatacctcttactatattagatatagaggcgctgtctatgcagactctggaaatttcaaacgatgcatcaacctatggaagtatgctttggatatgcagcagagcaatttggatcctttaagcccaatgaccgccagcagcttattatcttttgcagaactattctcctttatgctacaggatagggctaaaggcctgctgggtactactgttacatttgatgatcttatgggcatactttgcaaaagcgtccttgaaatagagcgagctatcaaacaaactcagtgtccagctgacccattacagttaaataaggccctttctattattttgcacttaatttgcttgttagagaaagttccttgtactctagaacaagaccatttcaaaaagcagactatatacaggtttcttaagctgcatccaaggggaaagaataacttcagccctcttcatctggctgtggacaagaatactacatgtgtagggcggtaccctgtttgtaaatttccatctctacaagttactgcaatactgatagaatgtggtgctgatgtgaacgtcagagactcggatgacaacagtcccctgcatatcgctgctcttaacaaccatccagacatcatgaatctccttattaaatcaggtgcacattttgatgccacaaacttgcacaaacaaactgctagtgacttgctggatgagaaggaaatagctaaaaatttaatccagcctataaatcataccacattgcagtgtcttgctgctcgtgtcatagtgaatcatagaatatattataaagggcatatcccagaaaagctagagacttttgtttcccttcatagatgataacttgactgtattttagcactgttaaagcacgaattggtaacagttgtttcataaatgagcactgttgtgataacaccagcattcatttagcttgattgatatcattgtgctctcattggctaaagcattataagcatcaaatttacaacattggtttcccaatatttaatataaatataccatataatatattgtttgtgaattattgagaaatgtaacattcaaatttctaaaattgtctgccaaaggcttattcattctggttttgtttgctgttgggtgtttggggcagagttaaccatttctccatggtgtctttatactttactggtttgtgaattttatacaattgaaagtctttttttcttgcttctttcttctcttctcaagtttcccccctgtttctactttattgtttgtcctaaccatttctactacagttttttccttatggacccatactaggttgtacaaaccttaaggactcgttaccatttgcagttaccataagtgctttatcttctctatgcacaggcttaaacttgactgttgtatgttagcatattttctatgcagcagttggtcaacttcaactcaaaacactgttttcttatgtttgttacaaacttaattttttgaaagtactctgtagcatgacaatttttagagctgcaggttagctattatagctcaagcttttttgtttgtttttttcttcactttcttcacatctgaggtttctttctctaatccactgaaattattgtgtgctaaatttgggaaacagatctattctaactcattaacccagttgaaatttaggtctgtcatcttaatatatcatgcagtaaaaggaagaatctttttaaagtgacccacctttcatgctgctccagcattgtcctgcttgtgctgatggtgtgattaggtgtagagaatttgcttaaatttaacttcaaagttcatcacacagcttaatgagtcacattgaaatactcagtaattgaactgcaaatcacttttagttacaaaaagagctaaagcatgtcagtggcatgatgcttgccaagccagatctaggcatctaggataattaaggtattttagtatgcaatttactgccataatatcaaaggtcagtaacagtgttctttctttcttcaagcttatgtatacctttaaagataacttgcatgaattactttgattactttggtctcaattatttgtcaccccagttaaacatgaaaggttgcagtgcttcctgttcccttactggaagttagctttttcttttctctttcttcctttctttctctcactctttctttctctttctctttctctctctctctctctctcactcactcactcacagatttgctaatgccacagaaagggctcttttaacttaagataagtgaaaagtactaaaaaagattcaggtaattatcattcagcactttattgtaattcagaataaaatttatgatggcatatttgccctgcaaatgtcttaatgaagttgttctcaataaaaagctccttattgatttgagaaaaaatcagtttacctgtgagttcaatgagctggatcactcacttggatttttgtgttgacattttattctgagggttgatgttacactatttaaggagtcatcaatgcaaacagtcacattaggtatgtcatcatctttagtcagtaaaaaccttgtaatgaggagtagtaaataaacaagagaacattagactttttggttaaataattgagatttaatttttaaaagatattcttactcatttgctaggttgtaaatttgatttcaccattaagaaaaggtaaattggatataaatgaacgatctccaactttttgatgaagaggttttactatctctcactgtgggaaaatttgatgaaatatttgaactgtcacatatattaagaatactttatgatttagaccaatattctagaaatatcaaatgtcagtatcttgaaatcatctgcctctaactttgtggtataagaattatatatgaataagctattatttttataaaggaaaactttgccattatagtaaattacattagttgatctcgataatttgaggataacagatgacaattgaatttttaattgatttagtatttcctcctcctctttgggggctgggtgggagggcttacatgctcttatagtgaggcacatctcactgttttgcagcagaatttgaattgtgcaactcctgtgtaaagtaaggatttctttaaatagcatttttgcaccagtaaaaatagataacttagaactcagtcttgataactgaaatgacttatttcacttagaatacatttctcccttctctgccatctccacaaatgccattgggaggttttgaaaaaccagttaatttaatagctcaaaattgtccctgattttattttcttttagggaaaattgtttcataaatgtgacactgataaagcctttgtcagaaagtattctcacaattatgagatggattataataaaatacttaaatttgtgttattttttgaaccacagatgagtaaatttaataatgaaccaattacactcttgagtctaactaaactgtacactgtagcacggtgttattgactggagttaatgtgtaagttattaacatttctatgaaaatgcccttttggggcctcctgaattttagatgttccactgttttgatcatttctataaaagaaatggtcattttacttagatgccagtctactttataaagacaaatggattatagacttaaaaatagtcatttttcttattcataaatctgacaggcataaacccaaatcaaagataatttggtgcccattatgaatttgaagttaagtgatagctcacttgtaaagtgactaccttaatgtgtatagagaccccagtctactattatttgggaaaattgtttaggttatatgggaaaagtagctctttaaaaatcatattgcccaacagaaaccttaggctgaatttacaggtatgataatttttgtaattaattttcttagaattgtgcaggctggatgagataatgacatactcttttacactgtaacagcagcattattgcctagaactttaaccattttagagttagatactaaggaaacaaactaattggtcatcatcattttctttttttctttttcttttttttttttttgcccttatgtgtcactaaacaactagtttctctcccttttgtcagttcccattgtgtattttttcaaaagaagtactgtattcggatgccagctaataaattgtcacacaatggaaaatcatatgccacaacattcattgtaaggtttaataaaattaaatttgcaccaaaaaaaagtcgacgcggccgcgaat

SEQ ID NO: 297927 - DNA, 2622 bp, Homo sapiens
caccccggccgcgacgccccgccccgcgcctaggctgttgctggccgcggccgccgccctcccccggcccaatggcgtggcggcacagtcagtgatgtgacgctcaggcttgtccggcccccggctcgcagcccattacaccatccgtcgcagcagtcgctgcagccgctgcagtccgagccgactaagggcgggaggcagctcgggtggcggggcgtggcgaacagcgcggccggattcattcctttggggcgcggagcatggaggagctgtgcggccgcaggcggagcagggcggcccgggcggcggtggggacaacggtttccctttgaaggggacggacaaagcccgagtgaccagcggcggcggggaggactagtccccgggcagtttggtgccctggttgtcagatgttggaaagcagtaggacggaacatactcttcgtggttgtgtatccgttctggggtgcagcaattaacattggactttggttcctgtgactcttgcctgtgtcgatagagttaaactggagctctgctttgaaagataaataaagcacagcctctcaactggacataaatggatctaaagacagcagtatttaacgcagctcgggatggcaaactccggcttctcaccaaattgttggcaagcaaatccaaagaggaggtttcctccttgatctctgaaaaaacaaatggggccacgccactcttgatggccgccaggtatgggcaccttgacatggtggaattcctcctagagcaatgcagtgcctccatagaagttgggggctccgtcaattttgatggcgaaaccattgagggggctccccctttatgggccgcttctgcagcaggacatctgaaggtggtccagtccttgttaaatcatggagcatctgtcaacaacacgactttaaccaattcaactcctcttcgagctgcgtgtttcgatggccatttggaaatagtgaagtaccttgtagaacacaaagctgatttggaagtgtcaaaccgacatgggcatacgtgcttgatgatttcatgttacaaaggacataaagagattgctcagtatttacttgaaaagggggcagatgttaatagaaaaagtgtcaaaggtaatactgcattgcatgattgtgcagaatctggaagtttggacatcatgaagatgcttcttatgtattgtgccaagatggaaaaggatggttatggaatgactccccttctctcagcaagtgtgactggtcacacaaatattgtggattttctgacacaccatgcacagaccagcaagacagaacgtattaatgctctagagcttctgggagctacatttgtagacaaaaaaagagatctgcttggggctttgaaatactggaaaaaggcaatgaacatgaggtacagtgataggactaatattattagtaaaccagtgccacagacactaataatggcttatgattatgccaaggaagtgaacagtgcagaagagctagaaggtcttattgctgatcctgatgagatgagaatgcaggcactattaatcagagaacgtattcttggtccttctcatcctgatacctcttactatattagatatagaggcgctgtctatgcagactctggaaatttcaaacgatgcatcaacctatggaagtatgctttggatatgcagcagagcaatttggatcctttaagcccaatgaccgccagcagcttattatcttttgcagaactattctcctttatgctacaggatagggctaaaggcctgctgggtactactgttacatttgatgatcttatgggcatactttgcaaaagcgtccttgaaatagagcgagctatcaaacaaactcagtgtccagctgacccattacagttaaataaggccctttctattattttgcacttaatttgcttgttagagaaagttccttgtactctagaacaagaccatttcaaaaagcagactatatacaggtttcttaagctgcatccaaggggaaagaataacttcagccctcttcatctggctgtggacaagaatactacatgtgtagggcggtaccctgtttgtaaatttccatctctacaagttactgcaatactgatagaatgtggtgctgatgtgaacgtcagagactcggatgacaacagtcccctgcatatcgctgctcttaacaaccatccagacatcatgaatctccttattaaatcaggtgcacattttgatgccacaaacttgcacaaacaaactgctagtgacttgctggatgagaaggaaatagctaaaaatttaatccagcctataaatcataccacattgcagtgtcttgctgctcgtgtcatagtgaatcatagaatatattataaagggcatatcccagaaaagctagagacttttgtttcccttcatagatgataacttgactgtattttagcactgttaaagcacgaattggtaacagttgtttcataaatgagcactgttgtgataacaccagcattcatttagcttgattgatatcattgtgctctcattggctaaagcattataagcatcaaatttacaacattggtttcccaatatttaatataaatataccatat

SEQ ID NO: 297928 - DNA, 938 bp, Homo sapiens
  misc_feature (11)..(11): n is a, c, g, or t
gatcctgacgntaatatgtaacctctgtagcatgacaatttttagagctgcaggttagctattatagctcaagcttttttgtttgtttttttcttcactttcttcacatctgaggtttctttctctaatccactgaaattattgtgtgctaaatttgggaaacagatctattctaactcattaacccagttgaaatttaggtctgtcatcttaatatatcatgcagtaaaaggaagaatctttttaaagtgacccacctttcatgctgctccagcattgtcctgcttgtgctgatggtgtgattaggtgtagagaatttgcttaaatttaacttcaaagttcatcacacagcttaatgagtcacattgaaatactcagtaattgaactgcaaatcacttttagttacaaaaagagctaaagcatgtcagtggcatgatgcttgccaagccagatctaggcatctaggataattaaggtattttagtatgcaatttactgccataatatcaaaggtcagtaacagtgttctttctttcttcaagcttatgtatacctttaaagataacttgcatgaattactttgattactttggtctcaattatttgtcaccccagttaaacatgaaaggttgcagtgcttcctgttcccttactggaagttagctttttcttttctctttcttcctttctttctctcactctttctttctctttctctttctctctctctctctctctcactcactcactcacagatttgctaatgccacagaaagggctcttttaacttaagataagtgaaaagtactaaaaaagattcaggtaattatcattcagcactttattgtaattcagaataaaatttatgatggcatatttgccctgcaaatgtcttaatgaagttgttctcaataaaaagctccttattgatttgaga

SEQ ID NO: 297929 - DNA, 848 bp, Homo sapiens
ctgaggtgatctagaggatccctagcttgggtgaaggagtgactgaaattattgtgtgctaaatttgggaaacagatctattctaactcattaacccagttgaaatttaggtctgtcatcttaatatatcatgcagtaaaaggaagaatctttttaaagtgacccacctttcatgctgctccagcattgtcctgcttgtgctgatggtgtgattaggtgtagagaatttgcttaaatttaacttcaaagttcatcacacagcttaatgagtcacattgaaatactcagtaattgaactgcaaatcacttttagttacaaaaagagctaaagcatgtcagtggcatgatgcttgccaagccagatctaggcatctaggataattaaggtattttagtatgcaatttactgccataatatcaaaggtcagtaacagtgttctttctttcttcaagcttatgtatacctttaaagataacttgcatgaattactttgattactttggtctcaattatttgtcaccccagttaaacatgaaaggttgcagtgcttcctgttcccttactggaagttagctttttcttttctctttcttcctttctttctctcactctttctttctctttctctttctctctctctctctctctcactcactcactcacagatttgctaatgccacagaaagggctcttttaacttaagataagtgaaaagtactaaaaaagattcaggtaattatcattcagcactttattgtaattcagaataaaatttatgatggcatatttgccctgcaaatgtcttaatgaagttgttctcaataaaaagctccttattgatttgaga

SEQ ID NO: 297930 - DNA, 405 bp, Homo sapiens
gaatgacttgtgcatctgcatcaccagcacttagcacagttcccggggggaactttgaggacggggttgtcctcaaagatttcttagataaataaagtgatagaatcaaactttacaagatgcagcaagaactgtgtgaagtcactcatttaatagcgacacaaaattattcatgattgccccaagattatcatagaacatccaatgaattatgtacagtaattgtcatgaagcatgaaaggtcaaaatgcattctcagtactttaaatgtaactttgaagtcttccttcaaaaattgagtaacttcttttccacattttggtgcttaagatgtaactcagttgcttccattactcagaaaattccctcatggtgcatcctcactctctgccccaccaacctggc

SEQ ID NO: 297931 - DNA, 3752 bp, Homo sapiens
gaatcggccgatgtgaaccgaatgttgatgtaagaggcagggcactcggctgcggatgggtaacagggcgtgggctggcacacttacttgcaccagtgcccagagagggggtgcaggctgaggagctgcccagagcaccgctcacactcccagagtacctgaagtcggcatttcaatgacaggtgacaagggtccccaaaggctaagcgggtccagctatggttccatctccagcccgaccagcccgaccagcccagggccacagcaagcacctcccagagagacctacctgagtgagaagatccccatcccagacacaaaaccgggcaccttcagcctgcggaagctatgggccttcacggggcctggcttcctcatgagcattgctttcctggacccaggaaacatcgagtcagatcttcaggctggcgccgtggcgggattcaaacttctctgggtgctgctctgggccaccgtgttgggcttgctctgccagcgactggctgcacgtctgggcgtggtgacaggcaaggacttgggcgaggtctgccatctctactaccctaaggtgccccgcaccgtcctctggctgaccatcgagctagccattgtgggctccgacatgcaggaagtcatcggcacggccattgcattcaatctgctctcagctggacgaatcccactctggggtggcgtcctcatcaccatcgtggacaccttcttcttcctcttcctcgataactacgggctgcggaagctggaagctttttttggactccttataaccattatggccttgacctttggctatgagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaagtctcgagagatagaccgggcccgccgagcggacatcagagaagccaacatgtacttcctgattgaggccaccatcgccctgtccgtctcctttatcatcaacctctttgtcatggctgtctttgggcaggccttctaccagaaaaccaaccaggctgcgttcaacatctgtgccaacagcagcctccacgactacgccaagatcttccccatgaacaacgccaccgtggccgtggacatttaccaggggggcgtgatcctgggctgcctgttcggccccgcggccctctacatctgggccataggtctcctggcggctgggcagagctccaccatgacgggcacctacgcgggacagttcgtgatggagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctgctcccgttcgccgtgctgcccatcctcacgttcaccagcatgcccaccctcatgcaggagtttgccaatggcctgctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtctggacctgttgccttgcccacggagccacctttctggcccacagctcccaccaccacttcctgtatgggctccttgaagaggaccagaaaggggagacctctggctaggcccacaccagggcctggctgggagtggcatgtatgacgtgactggcctgctggatgtggagggggcgcgtgcaggcagcaggatggagtgggacagttcctgagaccagccaacctgggggctttagggacctgctgtttcctagcgcagccatgtgattaccctctgggtctcagtgtcctcatctgtaaaatggagacaccaccacccttgccatggaggttaagcactttaacacagtgtctggcacttgggacaaaaacaaacaaacaaacaaaaaacatttcaaaaggtatttattgagcacctgcaggcgtgacctgacagcccaagggtgggtggggtgagggcttgaggacttgggcgggacacaggctccaaactggagcttgaaatagtgtctgatgaatgttaaattatctatctatctatttatttatttatttgagacagggaaagggtctccctctgttgccaaggctggagtgcagtggcgcaatcttaactcattgcaacctccaccttctgggttcaagcgattctctttattcagccccgggagtggcgcgcgccaccacgcccagctaatttgtgtattttcagcagagacggggtttgccatgctggccaggctggtctcgaactgctggattcaagtgatccgcccatctccgtctcccaaagtgctgggaattacaggcgtgagccaccaaacccggcctgattaaagttaaataaatactagttcccttctcgtccaaaggagcagggaatgggaaccgggaaggcacgaagtctctaaagcatccagaagacccctacaccagggtctggtccgctcctattcgccgcagcctttctgttccgcctgcaacccattttccagacagtaaaacggcggcgcacttctttctccgtcaggcaccaggtcataaggaacccaagagtctgtgcctctgaggcccaaattatttgctgtttcctcaggggagccggcggccgcgactcccacgccgcgccgttaccgctccctctctgctgactgctccccctaggggcagagacggtcccgacgcccgccatcccgccccggcctcacccctccccgccaggcggaacgacgcggggaggcgggcgctcggggctcgcgcccaggggccccagaatccttcggggagagtgggtgggaggaagctgtgtgggcggggagccccctctgccttagggagcggctgggcacccattcgccccattcaggggctgcactttatagacgttccctaggctgtttctaggctcccccaagtccctcctccagcctcgtcgggtccctcagaccccagcccaggacctgcggagggccgcagcgaggagaggccaacaggcctttccctagagttgaacctgggccgggtgttgcacctggaagaacccccgatttcctggggacccagcagggcaggcggcctggctccgcgctcaggtccggacgcttgtttatgagaagaatttcctctttcttaaaagggcaacgatgcgagtgggtccctcaaggagagaagagatgggaccggtctggtgcgacctgggcaagcgctgcagagggtacctgggcaagagggccgcccgcctcctctgggtttggcactggagaagatgggtccatgccagctgaaggaggagatggatgggggacgtttagcgaagaaaggcatctcccagatcctttagcctcctggaagtgcccccgttgtaccccctacacacccctcttggcattgagtgccagtcctctgccaggctctgtgttacaagttggggagggcggcaaagtcccgaattaaagatgtcagttctcaaggaccccacactccagcggcgggagacagctgtgcaaacaagtccctgtggcaggatgcggtg

SEQ ID NO: 297932 - DNA, 3609 bp, Homo sapiens
gaatcggccgatgtgaaccgaatgttgatgtaagaggcagggcactcggctgcggatgggtaacagggcgtgggctggcacacttacttgcaccagtgcccagagagggggtgcaggctgaggagctgcccagagcaccgctcacactcccagagtacctgaagtcggcatttcaatgacagggcaccttcagcctgcggaagctatgggccttcacggggcctggcttcctcatgagcattgctttcctggacccaggaaacatcgagtcagatcttcaggctggcgccgtggcgggattcaaacttctctgggtgctgctctgggccaccgtgttgggcttgctctgccagcgactggctgcacgtctgggcgtggtgacaggcaaggacttgggcgaggtctgccatctctactaccctaaggtgccccgcaccgtcctctggctgaccatcgagctagccattgtgggctccgacatgcaggaagtcatcggcacggccattgcattcaatctgctctcagctggacgaatcccactctggggtggcgtcctcatcaccatcgtggacaccttcttcttcctcttcctcgataactacgggctgcggaagctggaagctttttttggactccttataaccattatggccttgacctttggctatgagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaagtctcgagagatagaccgggcccgccgagcggacatcagagaagccaacatgtacttcctgattgaggccaccatcgccctgtccgtctcctttatcatcaacctctttgtcatggctgtctttgggcaggccttctaccagaaaaccaaccaggctgcgttcaacatctgtgccaacagcagcctccacgactacgccaagatcttccccatgaacaacgccaccgtggccgtggacatttaccaggggggcgtgatcctgggctgcctgttcggccccgcggccctctacatctgggccataggtctcctggcggctgggcagagctccaccatgacgggcacctacgcgggacagttcgtgatggagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctgctcccgttcgccgtgctgcccatcctcacgttcaccagcatgcccaccctcatgcaggagtttgccaatggcctgctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtctggacctgttgccttgcccacggagccacctttctggcccacagctcccaccaccacttcctgtatgggctccttgaagaggaccagaaaggggagacctctggctaggcccacaccagggcctggctgggagtggcatgtatgacgtgactggcctgctggatgtggagggggcgcgtgcaggcagcaggatggagtgggacagttcctgagaccagccaacctgggggctttagggacctgctgtttcctagcgcagccatgtgattaccctctgggtctcagtgtcctcatctgtaaaatggagacaccaccacccttgccatggaggttaagcactttaacacagtgtctggcacttgggacaaaaacaaacaaacaaacaaaaaacatttcaaaaggtatttattgagcacctgcaggcgtgacctgacagcccaagggtgggtggggtgagggcttgaggacttgggcgggacacaggctccaaactggagcttgaaatagtgtctgatgaatgttaaattatctatctatctatttatttatttatttgagacagggaaagggtctccctctgttgccaaggctggagtgcagtggcgcaatcttaactcattgcaacctccaccttctgggttcaagcgattctctttattcagccccgggagtggcgcgcgccaccacgcccagctaatttgtgtattttcagcagagacggggtttgccatgctggccaggctggtctcgaactgctggattcaagtgatccgcccatctccgtctcccaaagtgctgggaattacaggcgtgagccaccaaacccggcctgattaaagttaaataaatactagttcccttctcgtccaaaggagcagggaatgggaaccgggaaggcacgaagtctctaaagcatccagaagacccctacaccagggtctggtccgctcctattcgccgcagcctttctgttccgcctgcaacccattttccagacagtaaaacggcggcgcacttctttctccgtcaggcaccaggtcataaggaacccaagagtctgtgcctctgaggcccaaattatttgctgtttcctcaggggagccggcggccgcgactcccacgccgcgccgttaccgctccctctctgctgactgctccccctaggggcagagacggtcccgacgcccgccatcccgccccggcctcacccctccccgccaggcggaacgacgcggggaggcgggcgctcggggctcgcgcccaggggccccagaatccttcggggagagtgggtgggaggaagctgtgtgggcggggagccccctctgccttagggagcggctgggcacccattcgccccattcaggggctgcactttatagacgttccctaggctgtttctaggctcccccaagtccctcctccagcctcgtcgggtccctcagaccccagcccaggacctgcggagggccgcagcgaggagaggccaacaggcctttccctagagttgaacctgggccgggtgttgcacctggaagaacccccgatttcctggggacccagcagggcaggcggcctggctccgcgctcaggtccggacgcttgtttatgagaagaatttcctctttcttaaaagggcaacgatgcgagtgggtccctcaaggagagaagagatgggaccggtctggtgcgacctgggcaagcgctgcagagggtacctgggcaagagggccgcccgcctcctctgggtttggcactggagaagatgggtccatgccagctgaaggaggagatggatgggggacgtttagcgaagaaaggcatctcccagatcctttagcctcctggaagtgcccccgttgtaccccctacacacccctcttggcattgagtgccagtcctctgccaggctctgtgttacaagttggggagggcggcaaagtcccgaattaaagatgtcagttctcaaggaccccacactccagcggcgggagacagctgtgcaaacaagtccctgtggcaggatgcggtg

SEQ ID NO: 297933 - DNA, 2529 bp, Homo sapiens
gaatcggccgatgtgaaccgaatgttgatgtaagaggcagggcactcggctgcggatgggtaacagggcgtgggctggcacacttacttgcaccagtgcccagagagggggtgcaggctgaggagctgcccagagcaccgctcacactcccagagtacctgaagtcggcatttcaatgacaggtgacaagggtccccaaaggctaagcgggtccagctatggttccatctccagcccgaccagcccgaccagcccagggccacagcaagcacctcccagagagacctacctgagtgagaagatccccatcccagacacaaaaccgggcaccttcagcctgcggaagctatgggccttcacggggcctggcttcctcatgagcattgctttcctggacccaggaaacatcgagtcagatcttcaggctggcgccgtggcgggattcaaacttctctgggtgctgctctgggccaccgtgttgggcttgctctgccagcgactggctgcacgtctgggcgtggtgacaggcaaggacttgggcgaggtctgccatctctactaccctaaggtgccccgcaccgtcctctggctgaccatcgagctagccattgtgggctccgacatgcaggaagtcatcggcacggccattgcattcaatctgctctcagctggacgaatcccactctggggtggcgtcctcatcaccatcgtggacaccttcttcttcctcttcctcgataactacgggctgcggaagctggaagctttttttggactccttataaccattatggccttgacctttggctatgagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaagtctcgagagatagaccgggcccgccgagcggacatcagagaagccaacatgtacttcctgattgaggccaccatcgccctgtccgtctcctttatcatcaacctctttgtcatggctgtctttgggcaggccttctaccagaaaaccaaccaggctgcgttcaacatctgtgccaacagcagcctccacgactacgccaagatcttccccatgaacaacgccaccgtggccgtggacatttaccaggggggcgtgatcctgggctgcctgttcggccccgcggccctctacatctgggccataggtctcctggcggctgggcagagctccaccatgacgggcacctacgcgggacagttcgtgatggagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctgctcccgttcgccgtgctgcccatcctcacgttcaccagcatgcccaccctcatgcaggagtttgccaatggcctgctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtctggacctgttgccttgcccacggagccacctttctggcccacagctcccaccaccacttcctgtatgggctccttgaagaggaccagaaaggggagacctctggctaggcccacaccagggcctggctgggagtggcatgtatgacgtgactggcctgctggatgtggagggggcgcgtgcaggcagcaggatggagtgggacagttcctgagaccagccaacctgggggctttagggacctgctgtttcctagcgcagccatgtgattaccctctgggtctcagtgtcctcatctgtaaaatggagacaccaccacccttgccatggaggttaagcactttaacacagtgtctggcacttgggacaaaaacaaacaaacaaacaaaaaacatttcaaaaggtatttattgagcacctgcaggcgtgacctgacagcccaagggtgggtggggtgagggcttgaggacttgggcgggacacaggctccaaactggagcttgaaatagtgtctgatgaatgttaaattatctatctatctatttatttatttatttgagacagggaaagggtctccctctgttgccaaggctggagtgcagtggcgcaatcttaactcattgcaacctccaccttctgggttcaagcgattctctttattcagccccgggagtggcgcgcgcctgtagtcccaacggctcgggaggctgaggcaggaaaatcgcttgaacccgggaggcaaaggttgcggtgagccgagattttgcccctgcccccctccagcctggggacagagcgagactttgtttca

SEQ ID NO: 297934 - DNA, 3179 bp, Homo sapiens
gaatcggccgatgtgaaccgaatgttgatgtaagaggcagggcactcggctgcggatgggtaacagggcgtgggctggcacacttacttgcaccagtgcccagagagggggtgcaggctgaggagctgcccagagcaccgctcacactcccagagtacctgaagtcggcatttcaatgacaggtgacaagggtccccaaaggctaagcgggtccagctatggttccatctccagcccgaccagcccgaccagcccagggccacagcaagcacctcccagagagacctacctgagtgagaagatccccatcccagacacaaaaccgggcaccttcagcctgcggaagctatgggccttcacggggcctggcttcctcatgagcattgctttcctggacccaggaaacatcgagtcagatcttcaggctggcgccgtggcgggattcaaacttctctgggtgctgctctgggccaccgtgttgggcttgctctgccagcgactggctgcacgtctgggcgtggtgacaggcaaggacttgggcgaggtctgccatctctactaccctaaggtgccccgcaccgtcctctggctgaccatcgagctagccattgtgggctccgacatgcaggaagtcatcggcacggccattgcattcaatctgctctcagctggacgaatcccactctggggtggcgtcctcatcaccatcgtggacaccttcttcttcctcttcctcgataactacgggctgcggaagctggaagctttttttggactccttataaccattatggccttgacctttggctatgagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaagtctcgagagatagaccgggcccgccgagcggacatcagagaagccaacatgtacttcctgattgaggccaccatcgccctgtccgtctcctttatcatcaacctctttgtcatggctgtctttgggcaggccttctaccagaaaaccaaccaggctgcgttcaacatctgtgccaacagcagcctccacgactacgccaagatcttccccatgaacaacgccaccgtggccgtggacatttaccaggggggcgtgatcctgggctgcctgttcggccccgcggccctctacatctgggccataggtctcctggcggctgggcagagctccaccatgacgggcacctacgcgggacagttcgtgatggagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctgctcccgttcgccgtgctgcccatcctcacgttcaccagcatgcccaccctcatgcaggagtttgccaatggcctgctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtctggacctgttgccttgcccacggagccacctttctggcccacagctcccaccaccacttcctgtatgggctccttgaagaggaccagaaaggggagacctctggctaggcccacaccagggcctggctgggagtggcatcagagacggggtttgccatgctggccaggctggtctcgaactgctggattcaagtgatccgcccatctccgtctcccaaagtgctgggaattacaggcgtgagccaccaaacccggcctgattaaagttaaataaatactagttcccttctcgtccaaaggagcagggaatgggaaccgggaaggcacgaagtctctaaagcatccagaagacccctacaccagggtctggtccgctcctattcgccgcagcctttctgttccgcctgcaacccattttccagacagtaaaacggcggcgcacttctttctccgtcaggcaccaggtcataaggaacccaagagtctgtgcctctgaggcccaaattatttgctgtttcctcaggggagccggcggccgcgactcccacgccgcgccgttaccgctccctctctgctgactgctccccctaggggcagagacggtcccgacgcccgccatcccgccccggcctcacccctccccgccaggcggaacgacgcggggaggcgggcgctcggggctcgcgcccaggggccccagaatccttcggggagagtgggtgggaggaagctgtgtgggcggggagccccctctgccttagggagcggctgggcacccattcgccccattcaggggctgcactttatagacgttccctaggctgtttctaggctcccccaagtccctcctccagcctcgtcgggtccctcagaccccagcccaggacctgcggagggccgcagcgaggagaggccaacaggcctttccctagagttgaacctgggccgggtgttgcacctggaagaacccccgatttcctggggacccagcagggcaggcggcctggctccgcgctcaggtccggacgcttgtttatgagaagaatttcctctttcttaaaagggcaacgatgcgagtgggtccctcaaggagagaagagatgggaccggtctggtgcgacctgggcaagcgctgcagagggtacctgggcaagagggccgcccgcctcctctgggtttggcactggagaagatgggtccatgccagctgaaggaggagatggatgggggacgtttagcgaagaaaggcatctcccagatcctttagcctcctggaagtgcccccgttgtaccccctacacacccctcttggcattgagtgccagtcctctgccaggctctgtgttacaagttggggagggcggcaaagtcccgaattaaagatgtcagttctcaaggaccccacactccagcggcgggagacagctgtgcaaacaagtccctgtggcaggatgcggtg

SEQ ID NO: 297935 - DNA, 4047 bp, Homo sapiens
gaatcggccgatgtgaaccgaatgttgatgtaagaggcagggcactcggctgcggatgggtaacagggcgtgggctggcacacttacttgcaccagtgcccagagagggggtgcaggctgaggagctgcccagagcaccgctcacactcccagagtacctgaagtcggcatttcaatgacaggtgacaagggtccccaaaggctaagcgggtccagctatggttccatctccagcccgaccagcccgaccagcccagggccacagcaagcacctcccagagagacctacctgagtgagaagatccccatcccagacacaaaaccgcttctctgggtgctgctctgggccaccgtgttgggcttgctctgccagcgactggctgcacgtctgggcgtggtgacaggcaaggacttgggcgaggtctgccatctctactaccctaaggtgccccgcaccgtcctctggctgaccatcgagctagccattgtgggctccgacatgcaggaagtcatcggcacggccattgcattcaatctgctctcagctggacggtaccaccccagtgtaccccaactcttcaggccaggcagagaacagctgctgctacttccccccctaaccagtccctcccagagtctattttatcctgctgtcccctctgaagcagggctgctgccctgttttccagaaatgtaaagtgacttgtctaaagtcacacagatgtgagtcatgcaggactttgggactgcagccccaaactccctgctgcgccgggtgccaggtctctcctctagctctgccctgcctcgactgttctatgccacactcccactccccttgccctagctgtctgggggcgcttagggtcctgctcccaggaggccagattcctgtctccagccctgaggctccgtaggagttagagacccctggaccaggctgggctgacccgggccactctggtttcagaatcccactctggggtggcgtcctcatcaccatcgtggacaccttcttcttcctcttcctcgataactacgggctgcggaagctggaagctttttttggactccttataaccattatggccttgacctttggctatgagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaagtctcgagagatagaccgggcccgccgagcggacatcagagaagccaacatgtacttcctgattgaggccaccatcgccctgtccgtctcctttatcatcaacctctttgtcatggctgtctttgggcaggccttctaccagaaaaccaaccaggctgcgttcaacatctgtgccaacagcagcctccacgactacgccaagatcttccccatgaacaacgccaccgtggccgtggacatttaccaggggggcgtgatcctgggctgcctgttcggccccgcggccctctacatctgggccataggtctcctggcggctgggcagagctccaccatgacgggcacctacgcgggacagttcgtgatggagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctgctcccgttcgccgtgctgcccatcctcacgttcaccagcatgcccaccctcatgcaggagtttgccaatggcctgctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtctggacctgttgccttgcccacggagccacctttctggcccacagctcccaccaccacttcctgtatgggctccttgaagaggaccagaaaggggagacctctggctaggcccacaccagggcctggctgggagtggcatgtatgacgtgactggcctgctggatgtggagggggcgcgtgcaggcagcaggatggagtgggacagttcctgagaccagccaacctgggggctttagggacctgctgtttcctagcgcagccatgtgattaccctctgggtctcagtgtcctcatctgtaaaatggagacaccaccacccttgccatggaggttaagcactttaacacagtgtctggcacttgggacaaaaacaaacaaacaaacaaaaaacatttcaaaaggtatttattgagcacctgcaggcgtgacctgacagcccaagggtgggtggggtgagggcttgaggacttgggcgggacacaggctccaaactggagcttgaaatagtgtctgatgaatgttaaattatctatctatctatttatttatttatttgagacagggaaagggtctccctctgttgccaaggctggagtgcagtggcgcaatcttaactcattgcaacctccaccttctgggttcaagcgattctctttattcagccccgggagtggcgcgcgccaccacgcccagctaatttgtgtattttcagcagagacggggtttgccatgctggccaggctggtctcgaactgctggattcaagtgatccgcccatctccgtctcccaaagtgctgggaattacaggcgtgagccaccaaacccggcctgattaaagttaaataaatactagttcccttctcgtccaaaggagcagggaatgggaaccgggaaggcacgaagtctctaaagcatccagaagacccctacaccagggtctggtccgctcctattcgccgcagcctttctgttccgcctgcaacccattttccagacagtaaaacggcggcgcacttctttctccgtcaggcaccaggtcataaggaacccaagagtctgtgcctctgaggcccaaattatttgctgtttcctcaggggagccggcggccgcgactcccacgccgcgccgttaccgctccctctctgctgactgctccccctaggggcagagacggtcccgacgcccgccatcccgccccggcctcacccctccccgccaggcggaacgacgcggggaggcgggcgctcggggctcgcgcccaggggccccagaatccttcggggagagtgggtgggaggaagctgtgtgggcggggagccccctctgccttagggagcggctgggcacccattcgccccattcaggggctgcactttatagacgttccctaggctgtttctaggctcccccaagtccctcctccagcctcgtcgggtccctcagaccccagcccaggacctgcggagggccgcagcgaggagaggccaacaggcctttccctagagttgaacctgggccgggtgttgcacctggaagaacccccgatttcctggggacccagcagggcaggcggcctggctccgcgctcaggtccggacgcttgtttatgagaagaatttcctctttcttaaaagggcaacgatgcgagtgggtccctcaaggagagaagagatgggaccggtctggtgcgacctgggcaagcgctgcagagggtacctgggcaagagggccgcccgcctcctctgggtttggcactggagaagatgggtccatgccagctgaaggaggagatggatgggggacgtttagcgaagaaaggcatctcccagatcctttagcctcctggaagtgcccccgttgtaccccctacacacccctcttggcattgagtgccagtcctctgccaggctctgtgttacaagttggggagggcggcaaagtcccgaattaaagatgtcagttctcaaggaccccacactccagcggcgggagacagctgtgcaaacaagtccctgtggcaggatgcggtg

SEQ ID NO: 297936 - DNA, 3904 bp, Homo sapiens
gaatcggccgatgtgaaccgaatgttgatgtaagaggcagggcactcggctgcggatgggtaacagggcgtgggctggcacacttacttgcaccagtgcccagagagggggtgcaggctgaggagctgcccagagcaccgctcacactcccagagtacctgaagtcggcatttcaatgacagcttctctgggtgctgctctgggccaccgtgttgggcttgctctgccagcgactggctgcacgtctgggcgtggtgacaggcaaggacttgggcgaggtctgccatctctactaccctaaggtgccccgcaccgtcctctggctgaccatcgagctagccattgtgggctccgacatgcaggaagtcatcggcacggccattgcattcaatctgctctcagctggacggtaccaccccagtgtaccccaactcttcaggccaggcagagaacagctgctgctacttccccccctaaccagtccctcccagagtctattttatcctgctgtcccctctgaagcagggctgctgccctgttttccagaaatgtaaagtgacttgtctaaagtcacacagatgtgagtcatgcaggactttgggactgcagccccaaactccctgctgcgccgggtgccaggtctctcctctagctctgccctgcctcgactgttctatgccacactcccactccccttgccctagctgtctgggggcgcttagggtcctgctcccaggaggccagattcctgtctccagccctgaggctccgtaggagttagagacccctggaccaggctgggctgacccgggccactctggtttcagaatcccactctggggtggcgtcctcatcaccatcgtggacaccttcttcttcctcttcctcgataactacgggctgcggaagctggaagctttttttggactccttataaccattatggccttgacctttggctatgagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaagtctcgagagatagaccgggcccgccgagcggacatcagagaagccaacatgtacttcctgattgaggccaccatcgccctgtccgtctcctttatcatcaacctctttgtcatggctgtctttgggcaggccttctaccagaaaaccaaccaggctgcgttcaacatctgtgccaacagcagcctccacgactacgccaagatcttccccatgaacaacgccaccgtggccgtggacatttaccaggggggcgtgatcctgggctgcctgttcggccccgcggccctctacatctgggccataggtctcctggcggctgggcagagctccaccatgacgggcacctacgcgggacagttcgtgatggagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctgctcccgttcgccgtgctgcccatcctcacgttcaccagcatgcccaccctcatgcaggagtttgccaatggcctgctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtctggacctgttgccttgcccacggagccacctttctggcccacagctcccaccaccacttcctgtatgggctccttgaagaggaccagaaaggggagacctctggctaggcccacaccagggcctggctgggagtggcatgtatgacgtgactggcctgctggatgtggagggggcgcgtgcaggcagcaggatggagtgggacagttcctgagaccagccaacctgggggctttagggacctgctgtttcctagcgcagccatgtgattaccctctgggtctcagtgtcctcatctgtaaaatggagacaccaccacccttgccatggaggttaagcactttaacacagtgtctggcacttgggacaaaaacaaacaaacaaacaaaaaacatttcaaaaggtatttattgagcacctgcaggcgtgacctgacagcccaagggtgggtggggtgagggcttgaggacttgggcgggacacaggctccaaactggagcttgaaatagtgtctgatgaatgttaaattatctatctatctatttatttatttatttgagacagggaaagggtctccctctgttgccaaggctggagtgcagtggcgcaatcttaactcattgcaacctccaccttctgggttcaagcgattctctttattcagccccgggagtggcgcgcgccaccacgcccagctaatttgtgtattttcagcagagacggggtttgccatgctggccaggctggtctcgaactgctggattcaagtgatccgcccatctccgtctcccaaagtgctgggaattacaggcgtgagccaccaaacccggcctgattaaagttaaataaatactagttcccttctcgtccaaaggagcagggaatgggaaccgggaaggcacgaagtctctaaagcatccagaagacccctacaccagggtctggtccgctcctattcgccgcagcctttctgttccgcctgcaacccattttccagacagtaaaacggcggcgcacttctttctccgtcaggcaccaggtcataaggaacccaagagtctgtgcctctgaggcccaaattatttgctgtttcctcaggggagccggcggccgcgactcccacgccgcgccgttaccgctccctctctgctgactgctccccctaggggcagagacggtcccgacgcccgccatcccgccccggcctcacccctccccgccaggcggaacgacgcggggaggcgggcgctcggggctcgcgcccaggggccccagaatccttcggggagagtgggtgggaggaagctgtgtgggcggggagccccctctgccttagggagcggctgggcacccattcgccccattcaggggctgcactttatagacgttccctaggctgtttctaggctcccccaagtccctcctccagcctcgtcgggtccctcagaccccagcccaggacctgcggagggccgcagcgaggagaggccaacaggcctttccctagagttgaacctgggccgggtgttgcacctggaagaacccccgatttcctggggacccagcagggcaggcggcctggctccgcgctcaggtccggacgcttgtttatgagaagaatttcctctttcttaaaagggcaacgatgcgagtgggtccctcaaggagagaagagatgggaccggtctggtgcgacctgggcaagcgctgcagagggtacctgggcaagagggccgcccgcctcctctgggtttggcactggagaagatgggtccatgccagctgaaggaggagatggatgggggacgtttagcgaagaaaggcatctcccagatcctttagcctcctggaagtgcccccgttgtaccccctacacacccctcttggcattgagtgccagtcctctgccaggctctgtgttacaagttggggagggcggcaaagtcccgaattaaagatgtcagttctcaaggaccccacactccagcggcgggagacagctgtgcaaacaagtccctgtggcaggatgcggtg

SEQ ID NO: 297937 - DNA, 3826 bp, Homo sapiens
gaatcggccgatgtgaaccgaatgttgatgtaagaggcagggcactcggctgcggatgggtaacagggcgtgggctggcacacttacttgcaccagtgcccagagagggggtgcaggctgaggagctgcccagagcaccgctcacactcccagagtacctgaagtcggcatttcaatgacaggtgacaagggtccccaaaggctaagcgggtccagctatggttccatctccagcccgaccagcccgaccagcccagggccacagcaagcacctcccagagagacctacctgagtgagaagatccccatcccagacacaaaaccgggcaccttcagcctgcggaagctatgggccttcacggggcctggcttcctcatgagcattgctttcctggacccaggaaacatcgagtcagatcttcaggctggcgccgtggcgggattcaaacttctctgggtgctgctctgggccaccgtgttgggcttgctctgccagcgactggctgcacgtctgggcgtggtgacaggcaaggacttgggcgaggtctgccatctctactaccctaagtcggagtctcgctccgtcgcccagtcaggagtgcaatggtgcgatgtcagctcactgcaacctctacctcccaggtgccccgcaccgtcctctggctgaccatcgagctagccattgtgggctccgacatgcaggaagtcatcggcacggccattgcattcaatctgctctcagctggacgaatcccactctggggtggcgtcctcatcaccatcgtggacaccttcttcttcctcttcctcgataactacgggctgcggaagctggaagctttttttggactccttataaccattatggccttgacctttggctatgagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaagtctcgagagatagaccgggcccgccgagcggacatcagagaagccaacatgtacttcctgattgaggccaccatcgccctgtccgtctcctttatcatcaacctctttgtcatggctgtctttgggcaggccttctaccagaaaaccaaccaggctgcgttcaacatctgtgccaacagcagcctccacgactacgccaagatcttccccatgaacaacgccaccgtggccgtggacatttaccaggggggcgtgatcctgggctgcctgttcggccccgcggccctctacatctgggccataggtctcctggcggctgggcagagctccaccatgacgggcacctacgcgggacagttcgtgatggagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctgctcccgttcgccgtgctgcccatcctcacgttcaccagcatgcccaccctcatgcaggagtttgccaatggcctgctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtctggacctgttgccttgcccacggagccacctttctggcccacagctcccaccaccacttcctgtatgggctccttgaagaggaccagaaaggggagacctctggctaggcccacaccagggcctggctgggagtggcatgtatgacgtgactggcctgctggatgtggagggggcgcgtgcaggcagcaggatggagtgggacagttcctgagaccagccaacctgggggctttagggacctgctgtttcctagcgcagccatgtgattaccctctgggtctcagtgtcctcatctgtaaaatggagacaccaccacccttgccatggaggttaagcactttaacacagtgtctggcacttgggacaaaaacaaacaaacaaacaaaaaacatttcaaaaggtatttattgagcacctgcaggcgtgacctgacagcccaagggtgggtggggtgagggcttgaggacttgggcgggacacaggctccaaactggagcttgaaatagtgtctgatgaatgttaaattatctatctatctatttatttatttatttgagacagggaaagggtctccctctgttgccaaggctggagtgcagtggcgcaatcttaactcattgcaacctccaccttctgggttcaagcgattctctttattcagccccgggagtggcgcgcgccaccacgcccagctaatttgtgtattttcagcagagacggggtttgccatgctggccaggctggtctcgaactgctggattcaagtgatccgcccatctccgtctcccaaagtgctgggaattacaggcgtgagccaccaaacccggcctgattaaagttaaataaatactagttcccttctcgtccaaaggagcagggaatgggaaccgggaaggcacgaagtctctaaagcatccagaagacccctacaccagggtctggtccgctcctattcgccgcagcctttctgttccgcctgcaacccattttccagacagtaaaacggcggcgcacttctttctccgtcaggcaccaggtcataaggaacccaagagtctgtgcctctgaggcccaaattatttgctgtttcctcaggggagccggcggccgcgactcccacgccgcgccgttaccgctccctctctgctgactgctccccctaggggcagagacggtcccgacgcccgccatcccgccccggcctcacccctccccgccaggcggaacgacgcggggaggcgggcgctcggggctcgcgcccaggggccccagaatccttcggggagagtgggtgggaggaagctgtgtgggcggggagccccctctgccttagggagcggctgggcacccattcgccccattcaggggctgcactttatagacgttccctaggctgtttctaggctcccccaagtccctcctccagcctcgtcgggtccctcagaccccagcccaggacctgcggagggccgcagcgaggagaggccaacaggcctttccctagagttgaacctgggccgggtgttgcacctggaagaacccccgatttcctggggacccagcagggcaggcggcctggctccgcgctcaggtccggacgcttgtttatgagaagaatttcctctttcttaaaagggcaacgatgcgagtgggtccctcaaggagagaagagatgggaccggtctggtgcgacctgggcaagcgctgcagagggtacctgggcaagagggccgcccgcctcctctgggtttggcactggagaagatgggtccatgccagctgaaggaggagatggatgggggacgtttagcgaagaaaggcatctcccagatcctttagcctcctggaagtgcccccgttgtaccccctacacacccctcttggcattgagtgccagtcctctgccaggctctgtgttacaagttggggagggcggcaaagtcccgaattaaagatgtcagttctcaaggaccccacactccagcggcgggagacagctgtgcaaacaagtccctgtggcaggatgcggtg

SEQ ID NO: 297938 - DNA, 3761 bp, Homo sapiens
gaatcggccgatgtgaaccgaatgttgatgtaagaggcagggcactcggctgcggatgggtaacagggcgtgggctggcacacttacttgcaccagtgcccagagagggggtgcaggctgaggagctgcccagagcaccgctcacactcccagagtacctgaagtcggcatttcaatgacaggtgacaagggtccccaaaggctaagcgggtccagctatggttccatctccagcccgaccagcccgaccagcccagggccacagcaagcacctcccagagagacctacctgagtgagaagatccccatcccagacacaaaaccgggcaccttcagcctgcggaagctatgggccttcacggggcctggcttcctcatgagcattgctttcctggacccaggaaacatcgagtcagatcttcaggctggcgccgtggcgggattcaaacttctctgggtgctgctctgggccaccgtgttgggcttgctctgccagcgactggctgcacgtctgggcgtggtgacaggcaaggacttgggcgaggtctgccatctctactaccctaaggtgccccgcaccgtcctctggctgaccatcgagctagccattgtgggctccgacatgcaggaagtcatcggcacggccattgcattcaatctgctctcagctggacgaatcccactctggggtggcgtcctcatcaccatcgtggacaccttcttcttcctcttcctcgataactacgggctgggggaaagctggaaagctttcgtcgggacttccttatagccattattggccttgaaccttggggctatgcagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaagtctcgagagatagaccgggcccgccgagcggacatcagagaagccaacatgtacttcctgattgaggccaccatcgccctgtccgtctcctttatcatcaacctctttgtcatggctgtctttgggcaggccttctaccagaaaaccaaccaggctgcgttcaacatctgtgccaacagcagcctccacgactacgccaagatcttccccatgaacaacgccaccgtggccgtggacatttaccaggggggcgtgatcctgggctgcctgttcggccccgcggccctctacatctgggccataggtctcctggcggctgggcagagctccaccatgacgggcacctacgcgggacagttcgtgatggagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctgctcccgttcgccgtgctgcccatcctcacgttcaccagcatgcccaccctcatgcaggagtttgccaatggcctgctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtctggacctgttgccttgcccacggagccacctttctggcccacagctcccaccaccacttcctgtatgggctccttgaagaggaccagaaaggggagacctctggctaggcccacaccagggcctggctgggagtggcatgtatgacgtgactggcctgctggatgtggagggggcgcgtgcaggcagcaggatggagtgggacagttcctgagaccagccaacctgggggctttagggacctgctgtttcctagcgcagccatgtgattaccctctgggtctcagtgtcctcatctgtaaaatggagacaccaccacccttgccatggaggttaagcactttaacacagtgtctggcacttgggacaaaaacaaacaaacaaacaaaaaacatttcaaaaggtatttattgagcacctgcaggcgtgacctgacagcccaagggtgggtggggtgagggcttgaggacttgggcgggacacaggctccaaactggagcttgaaatagtgtctgatgaatgttaaattatctatctatctatttatttatttatttgagacagggaaagggtctccctctgttgccaaggctggagtgcagtggcgcaatcttaactcattgcaacctccaccttctgggttcaagcgattctctttattcagccccgggagtggcgcgcgccaccacgcccagctaatttgtgtattttcagcagagacggggtttgccatgctggccaggctggtctcgaactgctggattcaagtgatccgcccatctccgtctcccaaagtgctgggaattacaggcgtgagccaccaaacccggcctgattaaagttaaataaatactagttcccttctcgtccaaaggagcagggaatgggaaccgggaaggcacgaagtctctaaagcatccagaagacccctacaccagggtctggtccgctcctattcgccgcagcctttctgttccgcctgcaacccattttccagacagtaaaacggcggcgcacttctttctccgtcaggcaccaggtcataaggaacccaagagtctgtgcctctgaggcccaaattatttgctgtttcctcaggggagccggcggccgcgactcccacgccgcgccgttaccgctccctctctgctgactgctccccctaggggcagagacggtcccgacgcccgccatcccgccccggcctcacccctccccgccaggcggaacgacgcggggaggcgggcgctcggggctcgcgcccaggggccccagaatccttcggggagagtgggtgggaggaagctgtgtgggcggggagccccctctgccttagggagcggctgggcacccattcgccccattcaggggctgcactttatagacgttccctaggctgtttctaggctcccccaagtccctcctccagcctcgtcgggtccctcagaccccagcccaggacctgcggagggccgcagcgaggagaggccaacaggcctttccctagagttgaacctgggccgggtgttgcacctggaagaacccccgatttcctggggacccagcagggcaggcggcctggctccgcgctcaggtccggacgcttgtttatgagaagaatttcctctttcttaaaagggcaacgatgcgagtgggtccctcaaggagagaagagatgggaccggtctggtgcgacctgggcaagcgctgcagagggtacctgggcaagagggccgcccgcctcctctgggtttggcactggagaagatgggtccatgccagctgaaggaggagatggatgggggacgtttagcgaagaaaggcatctcccagatcctttagcctcctggaagtgcccccgttgtaccccctacacacccctcttggcattgagtgccagtcctctgccaggctctgtgttacaagttggggagggcggcaaagtcccgaattaaagatgtcagttctcaaggaccccacactccagcggcgggagacagctgtgcaaacaagtccctgtggcaggatgcggtg

SEQ ID NO: 297939 - DNA, 2900 bp, Homo sapiens
accagcctaatttttgtatttttagaggggtggagttccaccatgttggccaggctggtctcgaactcctgggctcaagtgatcttcccgccttggcttcccaaagtgctgggattacagacgtgagccaccccactcagctttgtttccttcatgtagcccagagggcgacactataagccccattttacagatgagaaaacagatcctgacagatgaggtgacttgctggaagctgcagacccaggactaacagaagccttttccccaaaactgtttagtcttcagcaaccagctatgggatgggagctccccatttctccccacccatcccctcttgccacctagggacagagctgtcccagttcaacagtggaaaaacagagcatgcccccagggataaatcggttgagggactacagaggatctctcctctggaatccccagtcctgtctactcctcaccaaggagctcacccccaccccagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctgctcccgttcgccgtgctgcccatcctcacgttcaccagcatgcccaccctcatgcaggagtttgccaatggcctgctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtctggacctgttgccttgcccacggagccacctttctggcccacagctcccaccaccacttcctgtatgggctccttgaagaggaccagaaaggggagacctctggctaggcccacaccagggcctggctgggagtggcatgtatgacgtgactggcctgctggatgtggagggggcgcgtgcaggcagcaggatggagtgggacagttcctgagaccagccaacctgggggctttagggacctgctgtttcctagcgcagccatgtgattaccctctgggtctcagtgtcctcatctgtaaaatggagacaccaccacccttgccatggaggttaagcactttaacacagtgtctggcacttgggacaaaaacaaacaaacaaacaaaaaacatttcaaaaggtatttattgagcacctgcaggcgtgacctgacagcccaagggtgggtggggtgagggcttgaggacttgggcgggacacaggctccaaactggagcttgaaatagtgtctgatgaatgttaaattatctatctatctatttatttatttatttgagacagggaaagggtctccctctgttgccaaggctggagtgcagtggcgcaatcttaactcattgcaacctccaccttctgggttcaagcgattctctttattcagccccgggagtggcgcgcgccaccacgcccagctaatttgtgtattttcagcagagacggggtttgccatgctggccaggctggtctcgaactgctggattcaagtgatccgcccatctccgtctcccaaagtgctgggaattacaggcgtgagccaccaaacccggcctgattaaagttaaataaatactagttcccttctcgtccaaaggagcagggaatgggaaccgggaaggcacgaagtctctaaagcatccagaagacccctacaccagggtctggtccgctcctattcgccgcagcctttctgttccgcctgcaacccattttccagacagtaaaacggcggcgcacttctttctccgtcaggcaccaggtcataaggaacccaagagtctgtgcctctgaggcccaaattatttgctgtttcctcaggggagccggcggccgcgactcccacgccgcgccgttaccgctccctctctgctgactgctccccctaggggcagagacggtcccgacgcccgccatcccgccccggcctcacccctccccgccaggcggaacgacgcggggaggcgggcgctcggggctcgcgcccaggggccccagaatccttcggggagagtgggtgggaggaagctgtgtgggcggggagccccctctgccttagggagcggctgggcacccattcgccccattcaggggctgcactttatagacgttccctaggctgtttctaggctcccccaagtccctcctccagcctcgtcgggtccctcagaccccagcccaggacctgcggagggccgcagcgaggagaggccaacaggcctttccctagagttgaacctgggccgggtgttgcacctggaagaacccccgatttcctggggacccagcagggcaggcggcctggctccgcgctcaggtccggacgcttgtttatgagaagaatttcctctttcttaaaagggcaacgatgcgagtgggtccctcaaggagagaagagatgggaccggtctggtgcgacctgggcaagcgctgcagagggtacctgggcaagagggccgcccgcctcctctgggtttggcactggagaagatgggtccatgccagctgaaggaggagatggatgggggacgtttagcgaagaaaggcatctcccagatcctttagcctcctggaagtgcccccgttgtaccccctacacacccctcttggcattgagtgccagtcctctgccaggctctgtgttacaagttggggagggcggcaaagtcccgaattaaagatgtcagttctcaaggaccccacactccagcggcgggagacagctgtgcaaacaagtccctgtggcaggatgcggtg

SEQ ID NO: 297940 - DNA, 2846 bp, Homo sapiens
accagcctaatttttgtatttttagaggggtggagttccaccatgttggccaggctggtctcgaactcctgggctcaagtgatcttcccgccttggcttcccaaagtgctgggattacagacgtgagccaccccactcagctttgtttccttcatgtagcccagagggcgacactataagccccattttacagatgagaaaacagatcctgacagatgaggtgacttgctggaagctgcagacccaggactaacagaagccttttccccaaaactgtttagtcttcagcaaccagctatgggatgggagctccccatttctccccacccatcccctcttgccacctagggacagagctgtcccagttcaacagtggacctctggaatccccagtcctgtctactcctcaccaaggagctcacccccaccccagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctgctcccgttcgccgtgctgcccatcctcacgttcaccagcatgcccaccctcatgcaggagtttgccaatggcctgctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtctggacctgttgccttgcccacggagccacctttctggcccacagctcccaccaccacttcctgtatgggctccttgaagaggaccagaaaggggagacctctggctaggcccacaccagggcctggctgggagtggcatgtatgacgtgactggcctgctggatgtggagggggcgcgtgcaggcagcaggatggagtgggacagttcctgagaccagccaacctgggggctttagggacctgctgtttcctagcgcagccatgtgattaccctctgggtctcagtgtcctcatctgtaaaatggagacaccaccacccttgccatggaggttaagcactttaacacagtgtctggcacttgggacaaaaacaaacaaacaaacaaaaaacatttcaaaaggtatttattgagcacctgcaggcgtgacctgacagcccaagggtgggtggggtgagggcttgaggacttgggcgggacacaggctccaaactggagcttgaaatagtgtctgatgaatgttaaattatctatctatctatttatttatttatttgagacagggaaagggtctccctctgttgccaaggctggagtgcagtggcgcaatcttaactcattgcaacctccaccttctgggttcaagcgattctctttattcagccccgggagtggcgcgcgccaccacgcccagctaatttgtgtattttcagcagagacggggtttgccatgctggccaggctggtctcgaactgctggattcaagtgatccgcccatctccgtctcccaaagtgctgggaattacaggcgtgagccaccaaacccggcctgattaaagttaaataaatactagttcccttctcgtccaaaggagcagggaatgggaaccgggaaggcacgaagtctctaaagcatccagaagacccctacaccagggtctggtccgctcctattcgccgcagcctttctgttccgcctgcaacccattttccagacagtaaaacggcggcgcacttctttctccgtcaggcaccaggtcataaggaacccaagagtctgtgcctctgaggcccaaattatttgctgtttcctcaggggagccggcggccgcgactcccacgccgcgccgttaccgctccctctctgctgactgctccccctaggggcagagacggtcccgacgcccgccatcccgccccggcctcacccctccccgccaggcggaacgacgcggggaggcgggcgctcggggctcgcgcccaggggccccagaatccttcggggagagtgggtgggaggaagctgtgtgggcggggagccccctctgccttagggagcggctgggcacccattcgccccattcaggggctgcactttatagacgttccctaggctgtttctaggctcccccaagtccctcctccagcctcgtcgggtccctcagaccccagcccaggacctgcggagggccgcagcgaggagaggccaacaggcctttccctagagttgaacctgggccgggtgttgcacctggaagaacccccgatttcctggggacccagcagggcaggcggcctggctccgcgctcaggtccggacgcttgtttatgagaagaatttcctctttcttaaaagggcaacgatgcgagtgggtccctcaaggagagaagagatgggaccggtctggtgcgacctgggcaagcgctgcagagggtacctgggcaagagggccgcccgcctcctctgggtttggcactggagaagatgggtccatgccagctgaaggaggagatggatgggggacgtttagcgaagaaaggcatctcccagatcctttagcctcctggaagtgcccccgttgtaccccctacacacccctcttggcattgagtgccagtcctctgccaggctctgtgttacaagttggggagggcggcaaagtcccgaattaaagatgtcagttctcaaggaccccacactccagcggcgggagacagctgtgcaaacaagtccctgtggcaggatgcggtg

SEQ ID NO: 297941 - DNA, 1983 bp, Homo sapiens
gaatcggccgatgtgaaccgaatgttgatgtaagaggcagggcactcggctgcggatgggtaacagggcgtgggctggcacacttacttgcaccagtgcccagagagggggtgcaggctgaggagctgcccagagcaccgctcacactcccagagtacctgaagtcggcatttcaatgacaggtgacaagggtccccaaaggctaagcgggtccagctatggttccatctccagcccgaccagcccgaccagcccagggccacagcaagcacctcccagagagacctacctgagtgagaagatccccatcccagacacaaaaccgggcaccttcagcctgcggaagctatgggccttcacggggcctggcttcctcatgagcattgctttcctggacccaggaaacatcgagtcagatcttcaggctggcgccgtggcgggattcaaacttctctgggtgctgctctgggccaccgtgttgggcttgctctgccagcgactggctgcacgtctgggcgtggtgacaggcaaggacttgggcgaggtctgccatctctactaccctaaggtgccccgcaccgtcctctggctgaccatcgagctagccattgtgggctccgacatgcaggaagtcatcggcacggccattgcattcaatctgctctcagctggacgaatcccactctggggtggcgtcctcatcaccatcgtggacaccttcttcttcctcttcctcgataactacgggctgcggaagctggaagctttttttggactccttataaccattatggccttgacctttggctatgagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaagtctcgagagatagaccgggcccgccgagcggacatcagagaagccaacatgtacttcctgattgaggccaccatcgccctgtccgtctcctttatcatcaacctctttgtcatggctgtctttgggcaggccttctaccagaaaaccaaccaggctgcggtgagacacactttcccccgcacctgaggccacacacgtactcatgtcctgtaagccttgccgaggaccctaggcaatgcagctgagcccttctgagtctctgccctgatgatcttccctgttggcagatatcattcattcagcaaataatcattgagcatttgttatataccaagcacatcctagaccctggggatacagcagtcaatgctacaaagacccagctctctgcagcttaaatagggagggaggtgagcagacaggaatgaatacccaagggaagtacagagtgggaagaaataaagggggtgaagaagcatagttgggggtatgggggtggggtctgcattagcccaggtggtcaggaaaggcttcttggaagagatgacatttgtgctaatactggaaaaggaactagccagctcctccctgactctctgggatctgggacctgtgtctgtctccccttctgagtggatctcagtcatgaggctctaacaactgcagccagggttgggggcttcctgaatgctgagccctgtgggagaaggggtggccaggcctccaaggacctgggcactgccactgccttgctctgtgaccttgggaggtcacactcctccctgggtctcactctgttccttggcacaaggagggagatcaacatcaggactgcaaacccttgtcttcaagaccaggcaggcgcagagttgtgggaagtggacagtgtgaagagggcatggcagccagctgtctctgtggtgatgccagctcttacgaacctaaaagaagctggaaactgggttcttatgccaggccttctcaattttaaatgttggcaacaaatccacatt

SEQ ID NO: 297942 - DNA, 550 bp, Homo sapiens
caggtgtgagccaccttgcctggcgtaatttatttatttatttagagatgggggtctcactatgttgctcaggctgctcttgaactcctggactcaagcaatcctcccaccttagccttttaaagtgctgggattacagggtgagctaccagcgcccagccaggatgggactccatctctcccaccccctccccgaggagtatgcttggttagagggtaccacgagctcaggggctttctgaggctggcctctctggctgaaggcctctccctgcctcctcacagcttctctgggtgctgctctgggccaccgtgttgggcttgctctgccagcgactggctgcacgtctgggcgtggtgacaggcaaggacttgggcgaggtctgccatctctactaccctaaggtgagcttggggggcctggacagggagaaccactggccccaaaccccaaacagccattttcagcttccacgatcaaataaatacatcatctcacatggggcatcccaagtctgtttgtttttgttgttgtttgtttgtttttcag

SEQ ID NO: 297943 - DNA, 513 bp, Homo sapiens
ttccacccattttatagatgagggaactgagcttcagagaggctgggtgggccaggttcacctgggtagctgtaaacccaaggacggatggaagtggagcagcatggctttcacagcgtgcccagtgtactcagagtgaccccagagtctgagaagtccctgagcatctgtctccctcgactccaagtcaggaataccgtgggcttcctgccctcaccccacacctcaagaccatcccactgcttgcctgcttgccccctgccatctcgcactcagccctgggtgcctgtgaagcctggccccactgcctgccgggggttcctgcagcacccccctactccaggctccccatctccctgaagcttccagggtagcagctggtgggacactgatctgtgagctctggaatgtctgcttagaattctgagaggcaggaactgctctgtctttgtaactactcaaggccaactgtcacatgaaggaatgaataaagagtttttactgacttgtgca

SEQ ID NO: 297944 - DNA, 1505 bp, Homo sapiens
atgcagctggtacggtctgggagttacggatggagccgtgggacgagggcggcgatggcgtcccatgtagagtgccgtcctctgggagtgtttgagtgtgaactctgtaccttgacagctccgtacagctatgtgggacagaagccccccaacacccagtcgatggtcctcctggaggaaagctatgtcatgaaggatcccttcacctccgacaaggacagattcctggtcctcggctcgtgctgcagtttgtgcagcaggctggtgtgtgtgggcccggaatgcagtttattctactccaagagattctgcctcccttgtgtccgggagaacatcaatgcttttcctcaggaaattcggcaagacttggagaaaaggaaagctccatcaaagaggacccccagccagcccggttctcggacgtgagtgcaactggggctaggtcatcgggcggcaccctgcacagagctcctgggccagcctgcgccagggatgctgctgagctgggagccgccatgcctggccttgtttctggaccactgggagcagcactgcagcccaggggagctggagtccagcttggagcagccacaggcccagggagctgtagcaagagggtagtccaaaggcagatgccagacaagacacagccaggaacccggccaggtccccccacatgcccctcagggcccaggcctgagtgagtgctgctcagatgtgactgagagggatgacctccttcagcagggcagctcctaagaggctgcgtgcaggtgcgtgtggggggagatgccacactgtgtcggggccatggtgcactgtaggtggctgcaatggtctctctgtaaggaaaatcactgacagcagctccttctggacccagtctggaaggtctagagggggatagaatttttatttcatatccttatgtggtgcttggaaaatgtttttaaccttgaccatgtattatgtttataattaaaaacccaaagaaccagctcatgtttggaaaaggaatcttccactgaaacatttggatacccgacgttctccctggacacttggcccggcaatagttggggtctcctgggaagctgagtgctggcttctagcctctccagttccctcagactctgtcttcagctcgggcccctccgttctgtctccctcgactccaagtcaggaataccgtgggcttcctgccctcaccccacacctcaagaccatcccactgcttgcctgcttgccccctgccatctcgcactcagccctgggtgcctgtgaagcctggccccactgcctgccgggggttcctgcagcacccccctactccaggctccccatctccctgaagcttccagggtagcagctggtgggacactgatctgtgagctctggaatgtctgcttagaattctgagaggcaggaactgctctgtctttgtaactactcaaggccaactgtcacatgaaggaatgaataaagagtttttactgacttgtgca

SEQ ID NO: 297945 - DNA, 1794 bp, Homo sapiens
tgactggggcgagcgtgctgtggcccttccctgcgctgcctcagggtgcctcccgctcgccgggactgagttccgcgccggcgtggcctgctgggttccaagcgccaggagtcggcgcagccgctctcagctttggggacgggaccgagaagcggggtgtgggcctcacgggactgtcccccctgacctcgggcagcgctggggcgagagagggcaggcggaggctcgcggggaccaccagcatccccggaccctctcagccgtccctgttcacaggcgccgcccccaggagcctcggcaggggcctaggacgccccggcgtgcagaagagaagcgggatcagatggcgtcccatgtagagtgccgtcctctgggagtgtttgagtgtgaactctgtaccttgacagctccgtacagctatgtgggacagaagccccccaacacccagtcgatggtcctcctggaggaaagctatgtcatgaaggatcccttcacctccgacaaggacagattcctggtcctcggctcgtgctgcagtttgtgcagcaggctggtgtgtgtgggcccggaatgcagtttattctactccaagagattctgcctcccttgtgtccgggagaacatcaatgcttttcctcaggaaattcggcaagacttggagaaaaggaaagctccatcaaagaggacccccagccagcccggttctcggacgtgagtgcaactggggctaggtcatcgggcggcaccctgcacagagctcctgggccagcctgcgccagggatgctgctgagctgggagccgccatgcctggccttgtttctggaccactgggagcagcactgcagcccaggggagctggagtccagcttggagcagccacaggcccagggagctgtagcaagagggtagtccaaaggcagatgccagacaagacacagccaggaacccggccaggtccccccacatgcccctcagggcccaggcctgagtgagtgctgctcagatgtgactgagagggatgacctccttcagcagggcagctcctaagaggctgcgtgcaggtgcgtgtggggggagatgccacactgtgtcggggccatggtgcactgtaggtggctgcaatggtctctctgtaaggaaaatcactgacagcagctccttctggacccagtctggaaggtctagagggggatagaatttttatttcatatccttatgtggtgcttggaaaatgtttttaaccttgaccatgtattatgtttataattaaaaacccaaagaaccagctcatgtttggaaaaggaatcttccactgaaacatttggatacccgacgttctccctggacacttggcccggcaatagttggggtctcctgggaagctgagtgctggcttctagcctctccagttccctcagactctgtcttcagctcgggcccctccgttctgtctccctcgactccaagtcaggaataccgtgggcttcctgccctcaccccacacctcaagaccatcccactgcttgcctgcttgccccctgccatctcgcactcagccctgggtgcctgtgaagcctggccccactgcctgccgggggttcctgcagcacccccctactccaggctccccatctccctgaagcttccagggtagcagctggtgggacactgatctgtgagctctggaatgtctgcttagaattctgagaggcaggaactgctctgtctttgtaactactcaaggccaactgtcacatgaaggaatgaataaagagtttttactgacttgtgca

SEQ ID NO: 297946 - DNA, 1376 bp, Homo sapiens
aggcgccttggacgcggagccgtgggacgagggcggcgcctcctggaggaaagctatgtcatgaaggatcccttcacctccgacaaggacagattcctggtcctcggctcgtgctgcagtttgtgcagcaggctggtgtgtgtgggcccggaatgcagtttattctactccaagagattctgcctcccttgtgtccgggagaacatcaatgcttttcctcaggaaattcggcaagacttggagaaaaggaaagctccatcaaagaggacccccagccagcccggttctcggacgtgagtgcaactggggctaggtcatcgggcggcaccctgcacagagctcctgggccagcctgcgccagggatgctgctgagctgggagccgccatgcctggccttgtttctggaccactgggagcagcactgcagcccaggggagctggagtccagcttggagcagccacaggcccagggagctgtagcaagagggtagtccaaaggcagatgccagacaagacacagccaggaacccggccaggtccccccacatgcccctcagggcccaggcctgagtgagtgctgctcagatgtgactgagagggatgacctccttcagcagggcagctcctaagaggctgcgtgcaggtgcgtgtggggggagatgccacactgtgtcggggccatggtgcactgtaggtggctgcaatggtctctctgtaaggaaaatcactgacagcagctccttctggacccagtctggaaggtctagagggggatagaatttttatttcatatccttatgtggtgcttggaaaatgtttttaaccttgaccatgtattatgtttataattaaaaacccaaagaaccagctcatgtttggaaaaggaatcttccactgaaacatttggatacccgacgttctccctggacacttggcccggcaatagttggggtctcctgggaagctgagtgctggcttctagcctctccagttccctcagactctgtcttcagctcgggcccctccgttctgtctccctcgactccaagtcaggaataccgtgggcttcctgccctcaccccacacctcaagaccatcccactgcttgcctgcttgccccctgccatctcgcactcagccctgggtgcctgtgaagcctggccccactgcctgccgggggttcctgcagcacccccctactccaggctccccatctccctgaagcttccagggtagcagctggtgggacactgatctgtgagctctggaatgtctgcttagaattctgagaggcaggaactgctctgtctttgtaactactcaaggccaactgtcacatgaaggaatgaataaagagtttttactgacttgtgca

SEQ ID NO: 297947 - DNA, 1393 bp, Homo sapiens
atgcagctggtacggtctgggagttacggatggagccgtgggacgagggcggcgatggcgtcccatgtagagtgccgtcctctgggagtgtttgagtgtgaactctgtaccttgacagctccgtacagctatgtgggacagaagccccccaacacccagtcgatggtgaatgcagtttattctactccaagagattctgcctcccttgtgtccgggagaacatcaatgcttttcctcaggaaattcggcaagacttggagaaaaggaaagctccatcaaagaggacccccagccagcccggttctcggacgtgagtgcaactggggctaggtcatcgggcggcaccctgcacagagctcctgggccagcctgcgccagggatgctgctgagctgggagccgccatgcctggccttgtttctggaccactgggagcagcactgcagcccaggggagctggagtccagcttggagcagccacaggcccagggagctgtagcaagagggtagtccaaaggcagatgccagacaagacacagccaggaacccggccaggtccccccacatgcccctcagggcccaggcctgagtgagtgctgctcagatgtgactgagagggatgacctccttcagcagggcagctcctaagaggctgcgtgcaggtgcgtgtggggggagatgccacactgtgtcggggccatggtgcactgtaggtggctgcaatggtctctctgtaaggaaaatcactgacagcagctccttctggacccagtctggaaggtctagagggggatagaatttttatttcatatccttatgtggtgcttggaaaatgtttttaaccttgaccatgtattatgtttataattaaaaacccaaagaaccagctcatgtttggaaaaggaatcttccactgaaacatttggatacccgacgttctccctggacacttggcccggcaatagttggggtctcctgggaagctgagtgctggcttctagcctctccagttccctcagactctgtcttcagctcgggcccctccgttctgtctccctcgactccaagtcaggaataccgtgggcttcctgccctcaccccacacctcaagaccatcccactgcttgcctgcttgccccctgccatctcgcactcagccctgggtgcctgtgaagcctggccccactgcctgccgggggttcctgcagcacccccctactccaggctccccatctccctgaagcttccagggtagcagctggtgggacactgatctgtgagctctggaatgtctgcttagaattctgagaggcaggaactgctctgtctttgtaactactcaaggccaactgtcacatgaaggaatgaataaagagtttttactgacttgtgca

SEQ ID NO: 297948 - DNA, 1612 bp, Homo sapiens
aggcgccttggacgcggagccgtgggacgagggcggcgatggcgtcccatgtagagtgccgtcctctgggagtgtttgagtgtgaactctgtaccttgacagctccgtacagctatgtgggacagaagccccccaacacccagtcgatggtcctcctggaggaaagctatgtcatgaaggatcccttcacctccgacaaggacagattcctggtcctcggctcgtgctgcagtttgtgcagcaggctggtgtgtgtgggcccgatgttcttggagggatctccaggagaagggactgtcctttcatgagcacttgttgtgtgccaggtcctgtgcttgggacctgttttactgctgaggcttcattcagtcctgccccttagtcaggaatgcagtttattctactccaagagattctgcctcccttgtgtccgggagaacatcaatgcttttcctcaggaaattcggcaagacttggagaaaaggaaagctccatcaaagaggacccccagccagcccggttctcggacgtgagtgcaactggggctaggtcatcgggcggcaccctgcacagagctcctgggccagcctgcgccagggatgctgctgagctgggagccgccatgcctggccttgtttctggaccactgggagcagcactgcagcccaggggagctggagtccagcttggagcagccacaggcccagggagctgtagcaagagggtagtccaaaggcagatgccagacaagacacagccaggaacccggccaggtccccccacatgcccctcagggcccaggcctgagtgagtgctgctcagatgtgactgagagggatgacctccttcagcagggcagctcctaagaggctgcgtgcaggtgcgtgtggggggagatgccacactgtgtcggggccatggtgcactgtaggtggctgcaatggtctctctgtaaggaaaatcactgacagcagctccttctggacccagtctggaaggtctagagggggatagaatttttatttcatatccttatgtggtgcttggaaaatgtttttaaccttgaccatgtattatgtttataattaaaaacccaaagaaccagctcatgtttggaaaaggaatcttccactgaaacatttggatacccgacgttctccctggacacttggcccggcaatagttggggtctcctgggaagctgagtgctggcttctagcctctccagttccctcagactctgtcttcagctcgggcccctccgttctgtctccctcgactccaagtcaggaataccgtgggcttcctgccctcaccccacacctcaagaccatcccactgcttgcctgcttgccccctgccatctcgcactcagccctgggtgcctgtgaagcctggccccactgcctgccgggggttcctgcagcacccccctactccaggctccccatctccctgaagcttccagggtagcagctggtgggacactgatctgtgagctctggaatgtctgcttagaattctgagaggcaggaactgctctgtctttgtaactactcaaggccaactgtcacatgaaggaatgaataaagagtttttactgacttgtgca

SEQ ID NO: 297949 - DNA, 935 bp, Homo sapiens
atgcagctggtacggtctgggagttacggatggagccgtgggacgagggcggcgatggcgtcccatgtagagtgccgtcctctgggagtgtttgagtgtgaactctgtaccttgacagctccgtacagctatgtgggacagaagccccccaacacccagtcgatggtcctcctggaggaaagctatgtcatgaaggatcccttcacctccgacaaggacagattcctggtcctcggctcgtgctgcagtttgtgcagcaggctggtgtgtgtgggcccggaatgcagtttattctactccaagagattctgcctcccttgtgtccgggagaacatcaatgcttttcctcaggaaattcggcaagacttggagaaaaggaaagctccatcaaagaggacccccagccagcccggttctcggacaaccagctcatgtttggaaaaggaatcttccactgaaacatttggatacccgacgttctccctggacacttggcccggcaatagttggggtctcctgggaagctgagtgctggcttctagcctctccagttccctcagactctgtcttcagctcgggcccctccgttctgtctccctcgactccaagtcaggaataccgtgggcttcctgccctcaccccacacctcaagaccatcccactgcttgcctgcttgccccctgccatctcgcactcagccctgggtgcctgtgaagcctggccccactgcctgccgggggttcctgcagcacccccctactccaggctccccatctccctgaagcttccagggtagcagctggtgggacactgatctgtgagctctggaatgtctgcttagaattctgagaggcaggaactgctctgtctttgtaactactcaaggccaactgtcacatgaaggaatgaataaagagtttttactgacttgtgca

SEQ ID NO: 297950 - DNA, 1048 bp, Homo sapiens
tgactggggcgagcgtgctgtggcccttccctgcgctgcctcagggtgcctcccgctcgccgggactgagttccgcgccggcgtggcctgctgggttccaagcgccaggagtcggcgcagccgctctcagctttggggacgggaccgagaagcggggtgtgggcctcacgggactgtcccccctgacctcgggcagcgctggggcgagagagggcaggcggaggctcgcggggaccaccagcatccccggaccctctcagccgtccctgttcacaggcgccgcccccaggagcctcggcaggggcctaggacgccccggcgtgcagaagagaagcgggatcagatggcgtcccatgtagagtgccgtcctctgggagtgtttgagtgtgaactctgtaccttgacagctccgtacagctatgtgggacagaagccccccaacacccagtcgatggtcctcctggaggaaagctatgtcatgaaggatcccttcacctccgacaaggacagattcctggtcctcggctcgtgctgcagtttgtgcagcaggctggtgtgtgtgggcccggaatgcagtttattctactccaagagattctgcctcccttgtgtccgggagaacatcaatgcttttcctcaggaaattcggcaagacttggagaaaaggaaagctccatcaaagaggacccccagccagcccggttctcggacgtgagtgcaactggggctaggtcatcgggcggcaccctgcacagagctcctgggccagcctgcgccagggatgctgctgagctgggagccgccatgcctggccttgtttctggaccactgggagcagcatgcctgccgggggttcctgcagcacccccctactccaggctccccatctccctgaagcttccagggtagcagctggtgggacactgatctgtgagctctggaatgtctgcttagaattctgagaggcaggaactgctctgtctttgtaactactcaaggccaactgtcacatgaaggaatgaataaagagtttttactgacttgtgca

SEQ ID NO: 297951 - DNA, 1300 bp, Homo sapiens
gttacaatctgaagtgggagcggcggtgaaggtcctgggtgaggtaggggtggatggtgcttgccgcgtatcatggctgcctccggaaaactcagcacttgccgtctccctccgttgcccacgattcgagaaatcattaagttgttaagactgcaagcagcgaagcagctatcacagaatttcctcctggacttgaggctgacagataagattgtaaggaaagctggcaatctgacaaatgcttatgtttacgaagtgggccctgggccagggggaatcacaagatctattcttaatgccgacgtcgctgaacttctggtggttgaaaaggacactcgatttattcctggattacagatgctttctgatgcagcacctgggaaactgagaattgttcatggagatgtcttgacatttaaggtagaaaaggctttttcagaaagtcttaaaagaccctgggaagatgatcctccaaatgtacatattattggaaatctgccttttagtgtttcaactccactgattatcaagtggcttgaaaatatttcctgtagagatggaccttttgtttatggcagaactcagatgactttgacttttcaaaaggaagtggcagagagacttgcagccaatacaggaagcaaacagcgtagtcgcctctctgttatggctcagtacctctgcaatgttcgacacatctttacaattccaggacaagcttttgtccccaaaccagaggtggacgtgggcgtggtgcacttcactcccttgatacagcccaagatagagcagccattcaagctggtggaaaaagtggttcagaatgtatttcagttccgaaggaaatactgccatcgagggctcagaatgttattccctgaagcgcagcgcttggaaagcacgggcaggctgttagagttggcagacatagaccctactcttcggccccgccagctctccatctcacactttaagagcctctgtgatgtatacagaaaaatgtgtgatgaagacccacaactctttgcatataatttcagagaagaactcaagcgaagaaaaagcaaaaatgaagaaaaagaagaggatgacgcagagaattacagactctagctgctgcctgggggcgagcagcctaccagatgtcgatttgcactacgtggagcttcttatataggtactcttttgtctttacagaatgacgatacaaatgccaatgaccagatgtgacttattttccttttactatacagcttggcagagaaaataaatatcatcaaataagatacagtaaaaaaat

SEQ ID NO: 297952 - DNA, 1126 bp, Homo sapiens
gttacaatctgaagtgggagcggcggtgaaggtcctgggtgaggtaggggtggatggtgcttgccgcgtatcatggctgcctccggaaaactcagcacttgccgtctccctccgttgcccacgattcgagaaatcattaagttgttaagactgcaagcagcgaagcagctatcacagaatttcctcctggacttgaggctgacagataagattgtaaggaaagctggcaatctgacaaatgcttatgtttacgaagtgggccctgggccagggggaatcacaagatctattcttaatgccgacgtcgctgaacttctggtggttgaaaaggacactcgatttattcctggattacagatgctttctgatgcagcacctgggaaactgagaattgttcatggagatgtcttgacatttaaggtagaaaaggctttttcagaaagtcttaaaagaccctgggaagatgatcctccaaatgtacatattattggaaatctgccttttagtgtttcaactccactgattatcaagtggcttgaaaatatttcctgtagagatggaccttttgtttatggcagaactcagatgactttgacttttcaaaaggaagtggcagagagacttgcagccaatacaggaagcaaacagcgtagtcgcctctctgttatggctcagtacctctgcaatgttcgacacatctttacaattccaggacaagcttttgtccccaaaccagaggtggacgtgggcgtggtgcacttcactcccttgatacagcccaagatagagcagccattcaagctggtggaaaaagtggttcagaatgtatttcagttccgaaggaaatactgccatcgagggctcagagaagaactcaagcgaagaaaaagcaaaaatgaagaaaaagaagaggatgacgcagagaattacagactctagctgctgcctgggggcgagcagcctaccagatgtcgatttgcactacgtggagcttcttatataggtactcttttgtctttacagaatgacgatacaaatgccaatgaccagatgtgacttattttccttttactatacagcttggcagagaaaataaatatcatcaaataagatacagtaaaaaaat

SEQ ID NO: 297953 - DNA, 814 bp, Homo sapiens
gttacaatctgaagtgggagcggcggtgaaggtcctgggtgaggtaggggtggatggtgcttgccgcgtatcatggctgcctccggaaaactcagcacttgccgtctccctccgttgcccacgattcgagaaatcattaagttgttaagactgcaagcagcgaagcagctatcacagaatttcctcctggacttgaggctgacagataagattgtaaggaaagctggcaatctgacaaatgcttatgtttacgaagtgggccctgggccagggggaatcacaagatctattcttaatgccgacgtcgctgaacttctggtggttgaaaaggacactcgatttattcctggattacaggtgagatgcttaaagtgtctgctttaggaggcaaaagctgaatttaaatctttatgccatgatgcttaaaccccaaggtatccaaagattatgtaggtttttcctcaactatagatccccaaggccccattccagagattttgattccatagtctggagaaatctggaaatctccatttttaacaagcactctcagagggtctattgactacaccttgaaaaaaacctgctttaagcatttatgctaaacaaattaattgttttgtgtgatttttttttttaagtctgctaatagctatgcatgtcgtggcccattccttcaaaaataaataaaaataaataataaccatgtgggcggcttgggccatctaattttgatttagcaagttattttggcggcccaatttagcccttggcacatacccttatggaggggttacaatcaaggggcggggtt

SEQ ID NO: 297954 - DNA, 1867 bp, Homo sapiens
gttacaatctgaagtgggagcggcggtgaaggtcctgggtgaggtaggggtggatggtgcttgccgcgtatcatggctgcctccggaaaactcagcacttgccgtctccctccgttgcccacgattcgagaaatcattaagttgttaagactgcaagcagcgaagcagctatcacagaatttcctcctggacttgaggctgacagataagattgtaaggaaagctggcaatctgacaaatgcttatgtttacgaagtgggccctgggccagggggaatcacaagatctattcttaatgccgacgtcgctgaacttctggtggttgaaaaggacactcgatttattcctggattacagatgctttctgatgcagcacctgggaaactgagaattgttcatggagatgtcttgacatttaaggtagaaaaggctttttcagaaagtcttaaaagaccctgggaagatgatcctccaaatgtacatattattggaaatctgccttttagtgtttcaactccactgattatcaagtggcttgaaaatatttcctgtagagatggaccttttgtttatggcagaactcagatgactttgacttttcaaaaggaagtggcagagagacttgcagccaatacaggaagcaaacagcgtagtcgcctctctgttatggctcagtacctctgcaatgttcgacacatctttacaattccaggacaagcttttgtccccaaaccagagtcctgcctatgcctttcggggcatttaaaattgctactagaaagttctgtggcttttcagactacactcatgaattcagtccagctgattaatcagtgtctaccgaaaataagtggtgtctctatctgggaagtttagcactgagtggtccctgggggcctgtctgccatctctctgtgtcttgaagctgctgctgcggcttatttttttcctcattcaaaaactaaaatattctaatgccatctattatctgctgactgactttaatgatttggattgatttttaagccattgtgaaactgtgttttaaaattaagtgaccatcaagcacaggtctggtggatgtcattagagaacaggtgcagccggctgatttctccatgtcatttgcgaatccagaatgtaccatcttccatgcctagagatgaaaccgaagtacgtggaaaggtctgtttatgaaaacaggctgttgacagcccatcttcctgttttacaaggatgagttgattgatcacactatgccacatatcatgccacagaatgataatatgtttgcttacaacgaaggtggacgtgggcgtggtgcacttcactcccttgatacagcccaagatagagcagccattcaagctggtggaaaaagtggttcagaatgtatttcagttccgaaggaaatactgccatcgagggctcagaatgttattccctgaagcgcagcgcttggaaagcacgggcaggctgttagagttggcagacatagaccctactcttcggccccgccagctctccatctcacactttaagagcctctgtgatgtatacagaaaaatgtgtgatgaagacccacaactctttgcatataatttcagagaagaactcaagcgaagaaaaagcaaaaatgaagaaaaagaagaggatgacgcagagaattacagactctagctgctgcctgggggcgagcagcctaccagatgtcgatttgcactacgtggagcttcttatataggtactcttttgtctttacagaatgacgatacaaatgccaatgaccagatgtgacttattttccttttactatacagcttggcagagaaaataaatatcatcaaataagatacagtaaaaaaat

SEQ ID NO: 297955 - DNA, 1482 bp, Homo sapiens
gttacaatctgaagtgggagcggcggtgaaggtcctgggtgaggtaggggtggatggtgcttgccgcgtatcatggctgcctccggaaaactcagcacttgccgtctccctccgttgcccacgattcgagaaatcattaagttgttaagactgcaagcagcgaagcagctatcacagaatttcctcctggacttgaggctgacaggtggatggcttagcagtgctccccggatgtctccccagtgtccgtgggggcgtgggccggggggtcttgcacgtccccgcgggcggttgtccaggcactggcgtgcgacgggcttttggtcaggtccttcgacctctttgtatcagaagaactccggtcccaccgcccaggagacacgtgaaataagattgtaaggaaagctggcaatctgacaaatgcttatgtttacgaagtgggccctgggccagggggaatcacaagatctattcttaatgccgacgtcgctgaacttctggtggttgaaaaggacactcgatttattcctggattacagatgctttctgatgcagcacctgggaaactgagaattgttcatggagatgtcttgacatttaaggtagaaaaggctttttcagaaagtcttaaaagaccctgggaagatgatcctccaaatgtacatattattggaaatctgccttttagtgtttcaactccactgattatcaagtggcttgaaaatatttcctgtagagatggaccttttgtttatggcagaactcagatgactttgacttttcaaaaggaagtggcagagagacttgcagccaatacaggaagcaaacagcgtagtcgcctctctgttatggctcagtacctctgcaatgttcgacacatctttacaattccaggacaagcttttgtccccaaaccagaggtggacgtgggcgtggtgcacttcactcccttgatacagcccaagatagagcagccattcaagctggtggaaaaagtggttcagaatgtatttcagttccgaaggaaatactgccatcgagggctcagaatgttattccctgaagcgcagcgcttggaaagcacgggcaggctgttagagttggcagacatagaccctactcttcggccccgccagctctccatctcacactttaagagcctctgtgatgtatacagaaaaatgtgtgatgaagacccacaactctttgcatataatttcagagaagaactcaagcgaagaaaaagcaaaaatgaagaaaaagaagaggatgacgcagagaattacagactctagctgctgcctgggggcgagcagcctaccagatgtcgatttgcactacgtggagcttcttatataggtactcttttgtctttacagaatgacgatacaaatgccaatgaccagatgtgacttattttccttttactatacagcttggcagagaaaataaatatcatcaaataagatacagtaaaaaaat

SEQ ID NO: 297956 - DNA, 1407 bp, Homo sapiens
gttacaatctgaagtgggagcggcggtgaaggtcctgggtgaggtaggggtggatggtgcttgccgcgtatcatggctgcctccggaaaactcagcacttgccgtctccctccgttgcccacgattcgagaaatcattaagttgttaagactgcaagcagcgaagcagctatcacagaatttcctcctggacttgaggctgacagatggagtttcactcttgttgcccaagctggagtgcaatggcatgatctcagctcactgcaacctccgcctccccggttcaagtgattctcgtgcctcagcctcccagataagattgtaaggaaagctggcaatctgacaaatgcttatgtttacgaagtgggccctgggccagggggaatcacaagatctattcttaatgccgacgtcgctgaacttctggtggttgaaaaggacactcgatttattcctggattacagatgctttctgatgcagcacctgggaaactgagaattgttcatggagatgtcttgacatttaaggtagaaaaggctttttcagaaagtcttaaaagaccctgggaagatgatcctccaaatgtacatattattggaaatctgccttttagtgtttcaactccactgattatcaagtggcttgaaaatatttcctgtagagatggaccttttgtttatggcagaactcagatgactttgacttttcaaaaggaagtggcagagagacttgcagccaatacaggaagcaaacagcgtagtcgcctctctgttatggctcagtacctctgcaatgttcgacacatctttacaattccaggacaagcttttgtccccaaaccagaggtggacgtgggcgtggtgcacttcactcccttgatacagcccaagatagagcagccattcaagctggtggaaaaagtggttcagaatgtatttcagttccgaaggaaatactgccatcgagggctcagaatgttattccctgaagcgcagcgcttggaaagcacgggcaggctgttagagttggcagacatagaccctactcttcggccccgccagctctccatctcacactttaagagcctctgtgatgtatacagaaaaatgtgtgatgaagacccacaactctttgcatataatttcagagaagaactcaagcgaagaaaaagcaaaaatgaagaaaaagaagaggatgacgcagagaattacagactctagctgctgcctgggggcgagcagcctaccagatgtcgatttgcactacgtggagcttcttatataggtactcttttgtctttacagaatgacgatacaaatgccaatgaccagatgtgacttattttccttttactatacagcttggcagagaaaataaatatcatcaaataagatacagtaaaaaaat

SEQ ID NO: 297957 - DNA, 1435 bp, Homo sapiens
gaaagtgggaaactgatcgactcaaatattagggccgaacccgggaagccttttaacggcgggctgggcgcgtatcgtatcatacgattgtcagcaatcgcgaatgatcgtcagacgatcatacatagacaaaactcaacaagtaagcaaaaagtggcttacagccaaagtgactttttagtccatacaaagtataagtacggagatcagtggtagaagcaggcccactgacaactgtaagaagtaacagttgttacagtaacagaaagctataaaagacaaatataaacgcagaagaaacaataataataatagggtagcaaaaacaccttcgtaactattgaggccattattctaaagacaacagtaaccctaggtcatcaagaaaagggtgaaatttggtttagtgttcttggcctaaggaagaggattgtgccatatagcatccctatacattggcctaaggaagaaggttgtgtcgttggcatacctatgctttctgatgcagcacctgggaaactgagaattgttcatggagatgtcttgacatttaaggtagaaaaggctttttcagaaagtcttaaaagaccctgggaagatgatcctccaaatgtacatattattggaaatctgccttttagtgtttcaactccactgattatcaagtggcttgaaaatatttcctgtagagatggaccttttgtttatggcagaactcagatgactttgacttttcaaaaggaagtggcagagagacttgcagccaatacaggaagcaaacagcgtagtcgcctctctgttatggctcagtacctctgcaatgttcgacacatctttacaattccaggacaagcttttgtccccaaaccagaggtggacgtgggcgtggtgcacttcactcccttgatacagcccaagatagagcagccattcaagctggtggaaaaagtggttcagaatgtatttcagttccgaaggaaatactgccatcgagggctcagaatgttattccctgaagcgcagcgcttggaaagcacgggcaggctgttagagttggcagacatagaccctactcttcggccccgccagctctccatctcacactttaagagcctctgtgatgtatacagaaaaatgtgtgatgaagacccacaactctttgcatataatttcagagaagaactcaagcgaagaaaaagcaaaaatgaagaaaaagaagaggatgacgcagagaattacagactctagctgctgcctgggggcgagcagcctaccagatgtcgatttgcactacgtggagcttcttatataggtactcttttgtctttacagaatgacgatacaaatgccaatgaccagatgtgacttattttccttttactatacagcttggcagagaaaataaatatcatcaaataagatacagtaaaaaaat

SEQ ID NO: 297958 - DNA, 1548 bp, Homo sapiens
tgtttcttctcgttgatacattcactcctgccttttaaatgctttctgatgcagcacctgggaaactgagaattgttcatggagatgtcttgacatttaaggtagaaaaggctttttcagaaagtcttaaaagaccctgggaagatgatcctccaaatgtacatattattggaaatctgccttttagtgtttcaactccactgattatcaagtggcttgaaaatatttcctgtagagatggaccttttgtttatggcagaactcagatgactttgacttttcaaaaggaagtggcagagagacttgcagccaatacaggaagcaaacagcgtagtcgcctctctgttatggctcagtacctctgcaatgttcgacacatctttacaattccaggacaagcttttgtccccaaaccagagtcctgcctatgcctttcggggcatttaaaattgctactagaaagttctgtggcttttcagactacactcatgaattcagtccagctgattaatcagtgtctaccgaaaataagtggtgtctctatctgggaagtttagcactgagtggtccctgggggcctgtctgccatctctctgtgtcttgaagctgctgctgcggcttatttttttcctcattcaaaaactaaaatattctaatgccatctattatctgctgactgactttaatgatttggattgatttttaagccattgtgaaactgtgttttaaaattaagtgaccatcaagcacaggtctggtggatgtcattagagaacaggtgcagccggctgatttctccatgtcatttgcgaatccagaatgtaccatcttccatgcctagagatgaaaccgaagtacgtggaaaggtctgtttatgaaaacaggctgttgacagcccatcttcctgttttacaaggatgagttgattgatcacactatgccacatatcatgccacagaatgataatatgtttgcttacaacgaaggtggacgtgggcgtggtgcacttcactcccttgatacagcccaagatagagcagccattcaagctggtggaaaaagtggttcagaatgtatttcagttccgaaggaaatactgccatcgagggctcagaatgttattccctgaagcgcagcgcttggaaagcacgggcaggctgttagagttggcagacatagaccctactcttcggccccgccagctctccatctcacactttaagagcctctgtgatgtatacagaaaaatgtgtgatgaagacccacaactctttgcatataatttcagagaagaactcaagcgaagaaaaagcaaaaatgaagaaaaagaagaggatgacgcagagaattacagactctagctgctgcctgggggcgagcagcctaccagatgtcgatttgcactacgtggagcttcttatataggtactcttttgtctttacagaatgacgatacaaatgccaatgaccagatgtgacttattttccttttactatacagcttggcagagaaaataaatatcatcaaataagatacagtaaaaaaat

SEQ ID NO: 297959 - DNA, 343 bp, Homo sapiens
gcggccgcctactactactactactgctcgaattcaagcttctaacgatgtacggggacatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacag

SEQ ID NO: 297960 - DNA, 4115 bp, Homo sapiens
aggccacttctgcaattacagacagttgcacttcaaggggacccttctttcacactacatccttctgtttttagactttttttgcgtttgaaaatgtgttttttgaggtggaatacccaactgacccctcatctctcctctctctctgctgccctgcagtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacag

SEQ ID NO: 297961 - DNA, 6783 bp, Homo sapiens
tgagactgtagaagagagagcaattggccaatgaggactgcggggcgggaccctgtgccgcggcggagtccaagatggcggcgtgcggttccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctccacctggacaagtccagcagtcgaggtggcagccgcgagtatgataccggtgggggcagctccagtagccgcttgcatagttatagctccccgagcaccaaaaattcttcgggcgggggcgagtcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaagagactacccgttctatgagagagtgcgccctgcatacagtcttgagccaagggtgggagctggagcaggtgctgctcctttcagagaagtggatgagatttcacccgaggatgatcagcgagctaaccggacgctcttcttgggcaacctagacatcactgtaacggagagtgatttaagaagggcgtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaagctacacccaccacccgcctctgggtgggaggcctgggaccttgggttcctcttgctgccctggcacgagaatttgatcgatttggcaccatacgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttacgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacagacgaggtagtttggagaagagccagggtgacaagcgagaccgtaaaaactctgcatcagctgaacgagataggaagcaccggacaactgctcccactgagggaaaaagccctctgaaaaaagaagaccgctctgatgggagtgcacctagcaccagcactgcttcctccaagctgaagtccccgtcccagaaacaggatggggggacagcccctgtggcatcagcctctcccaaactctgtttggcctggcagggcatgcttctactgaagaacagcaactttccttccaacatgcatctgttgcagggtgacctccaagtggctagtagtcttcttgtggagggttcaactggaggcaaagtggcccagctcaagatcactcagcgtctccgtttggaccagcccaagttggatgaagtaactcgacgcatcaaagtagcagggcccaatggttatgccattcttttggctgtgcctggaagttctgacagccggtcctcctcttcctcagctgcatcagacactgccacttctactcagaggccacttaggaaccttgtgtcctatttaaagcaaaagcaggcagccggggtgatcagcctccctgtggggggcaacaaagacaaggaaaacaccggggtccttcatgccttcccaccttgtgagttctcccagcagttcctggattcccctgccaaggcactggccaaatctgaagaagattacctggtcatgatcattgtccgtgctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacag

SEQ ID NO: 297962 - DNA, 757 bp, Homo sapiens
aggccacttctgcaattacagacagttgcacttcaaggggacccttctttcacactacatccttctgtttttagactttttttgcgtttgaaaatgtgttttttgaggtggaatacccaactgacccctcatctctcctctctctctgctgccctgcagtgctacagttgaaactccagcagcgccggacccgggaagaactggtgagccaagggatcatgccgcgtaagtgcctctctctctcagcatttggtagattgcttttaggacatggctgtgttcaccgagtatgccatgggaagcatctaacataaaacaagaatgaatgaagacagccagttgtaaagtacagtgtgtgcatgtgtatatgagagagagagtctgacaaactgaaatagataccgctctattgaaaacctgttggaattctgggcatggagtttgaaacaacactcccattctgtcaggagcccggattctaaaattgtcctgaatatctaattgtatactttgggttgttctctgtgtctgtgaagtgagaataattgcctttcctgtgggaatagaaatgacctgcttctatgagaatattgcattttcccatataccaagatccaccttcagctatggacatagtcttgttatcagcttttctagagaaggaagtaggtaagaaatgcttagattatgagagagaatgttgaggactgggaatagtttcaggtgtgaatttcctcctcatttacgtccctgttgg

SEQ ID NO: 297963 - DNA, 4397 bp, Homo sapiens
agcatggcatggatcacagccggctttaactcggtcacagggcagatgtgttaaggtacagtggtcccttcgatcacagctgatattagccggatcgggcacgggtctccgaccaggtgagttatggaccagctcactggattgctagtctatactcatttgtcagtccatacacacaactaaagctctgacaacatgtggcctattaccctggctactagacaggtgaccctgctgcctacagacagtcaatgattccggccctgccttcacaaagtgagcggacagagtgaaaaatgtctcaaattgggtataacaaatcagcgtgattgcctttcacctccactttggagtgctttgagccagtttggacacaaggaggttggagttaaaatgactcctgaaggaagtaagcaagcatgagaagagagggcagcactgtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacag

SEQ ID NO: 297964 - DNA, 4354 bp, Homo sapiens
gctgagaggagccggcggcggcagtgtctgtggtggccgcggcggcgagagcgacggtcccatctttcccaccctcttggttgccgctggccacacgccctccgctggcggcgacttctcagctccgtgcgcccgggctggacagtgagcctcgagaggagacgcgggcggctagagccggagtggggcgagccgcggaacccggccgggagccgcgcgaggcgtgatcggagggtatggttggcatggaattgaatttcatctgtctgtgggaattgtaagcaagattgccatcacgaaagccaaagtggatttctccagtgtggtgtgcctgcccccttccgtcattgctgtgaatgggctggacggaggaggggccggcgaaaatgatgatgaaccagtgctcgtgtccttatctgcggcacccagtccccagagtgaagctgttgccaatgaactgcaggagctctccttgcagcccgagctgaccctaggcctccaccctggcaggaatcccaatttgcctccacttagtgagcggaagaatgtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacag

SEQ ID NO: 297965 - DNA, 3816 bp, Homo sapiens
cctcgggaccattcctagcctgggcaataagagctggtcaggctgtacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacag

SEQ ID NO: 297966 - DNA, 4412 bp, Homo sapiens
gctgagaggagccggcggcggcagtgtctgtggtggccgcggcggcgagagcgacggtcccatctttcccaccctcttggttgccgctggccacacgccctccgctggcggcgacttctcagctccgtgcgcccgggctggacagtgagcctcgagaggagacgcgggcggctagagccggagtggggcgagccgcggaacccggccgggagccgcgcgaggcgtgatcggagggtatggttggcatggaattgaatttcatctgtctgtgggaattgtaagcaagattgccatcacgaaagccaaagtggatttctccagtgtggtgtgcctgcccccttccgtcattgctgtgaatgggctggacggaggaggggccggcgaaaatgatgatgaaccagtgctcgtgtccttatctgcggcacccagtccccagagtgaagctgttgccaatgaactgcaggagctctccttgcagcccgagctgaccctaggcctccaccctggcaggaatcccaatttgcctccacttagtgagcggaagaatgtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgtggcttcacattctgggctgactcataggggagtaggggtggagtcaccaaaaccagtgctgggacaaagatggggaaggtgtgtgaactttttaaaataaacacaaaaacacag

SEQ ID NO: 297967 - DNA, 1874 bp, Homo sapiens
agccccctggccactggtcctctccctgctctcctgtccagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacag

SEQ ID NO: 297968 - DNA, 3232 bp, Homo sapiens
gctgagaggagccggcggcggcagtgtctgtggtggccgcggcggcgagagcgacggtcccatctttcccaccctcttggttgccgctggccacacgccctccgctggcggcgacttctcagctccgtgcgcccgggctggacagtgagcctcgagaggagacgcgggcggctagagccggagtggggcgagccgcggaacccggccgggagccgcgcgaggcgtgatcggagggtatggttggcatggaattgaatttcatctgtctgtgggaattgtaagcaagattgccatcacgaaagccaaagtggatttctccagtgtggtgtgcctgcccccttccgtcattgctgtgaatgggctggacggaggaggggccggcgaaaatgatgatgaaccagtgctcgtgtccttatctgcggcacccagtccccagagtgaagctgttgccaatgaactgcaggagctctccttgcagcccgagctgaccctaggcctccaccctggcaggaatcccaatttgcctccacttagtgagcggaagaatgtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacag

SEQ ID NO: 297969 - DNA, 1536 bp, Homo sapiens
gctgagaggagccggcggcggcagtgtctgtggtggccgcggcggcgagagcgacggtcccatctttcccaccctcttggttgccgctggccacacgccctccgctggcggcgacttctcagctccgtgcgcccgggctggacagtgagcctcgagaggagacgcgggcggctagagccggagtggggcgagccgcggaacccggccgggagccgcgcgaggcgtgatcggagggtatggttggcatggaattgaatttcatctgtctgtgggaattgtaagcaagattgccatcacgaaagccaaagtggatttctccagtgtggtgtgcctgcccccttccgtcattgctgtgaatgggctggacggaggaggggccggcgaaaatgatgatgaaccagtgctcgtgtccttatctgcggcacccagtccccagagtgaagctgttgccaatgaactgcaggagctctccttgcagcccgagctgaccctaggcctccaccctggcaggaatcccaatttgcctccacttagtgagcggaagaatgtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggactctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacag

SEQ ID NO: 297970 - DNA, 1173 bp, Homo sapiens
gctgagaggagccggcggcggcagtgtctgtggtggccgcggcggcgagagcgacggtcccatctttcccaccctcttggttgccgctggccacacgccctccgctggcggcgacttctcagctccgtgcgcccgggctggacagtgagcctcgagaggagacgcgggcggctagagccggagtggggcgagccgcggaacccggccgggagccgcgcgaggcgtgatcggagggtatggttggcatggaattgaatttcatctgtctgtgggaattgtaagcaagattgccatcacgaaagccaaagtggatttctccagtgtggtgtgcctgcccccttccgtcattgctgtgaatgggctggacggaggaggggccggcgaaaatgatgatgaaccagtgctcgtgtccttatctgcggcacccagtccccagagtgaagctgttgccaatgaactgcaggagctctccttgcagcccgagctgaccctaggcctccaccctggcaggaatcccaatttgcctccacttagtgagcggaagaatgtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgaggaggacccagccaccctgtgtgagaggcagctgagatgcaggaggggagggagtgccaggctgaagcagaattgggctgaggctcttgacttcttaatctttgacttcctgcttagccttgggagaaccaaggcacagagtttgagagcctcatgcacaggttgtatgaacttgggatagtgcctgttgctttaagaaacagggacatacaacaataaataataacagaggccttgctctgttcactttcatctttgtaaa

SEQ ID NO: 297971 - DNA, 764 bp, Homo sapiens
gctgagaggagccggcggcggcagtgtctgtggtggccgcggcggcgagagcgacggtcccatctttcccaccctcttggttgccgctggccacacgccctccgctggcggcgacttctcagctccgtgcgcccgggctggacagtgagcctcgagaggagacgcgggcggctagagccggagtggggcgagccgcggaacccggccgggagccgcgcgaggcgtgatcggagggtatggttggcatggaattgaatttcatctgtctgtgggaattgtaagcaagattgccatcacgaaagccaaagtggatttctccagtgtggtgtgcctgcccccttccgtcattgctgtgaatgggctggacggaggaggggccggcgaaaatgatgatgaaccagtgctcgtgtccttatctgcggcacccagtccccagagtgaagctgttgccaatgaactgcaggagctctccttgcagcccgagctgaccctaggcctccaccctggcaggaatcccaatttgcctccacttagtgagcggaagaatgtgctacagttgaaactccagcagcgccggacccgggaagaactggtgagccaagggatcatgccgccaaaactggttgaacagcggatgaagatatggaattcaaagctctaatggacctttttgaagagaagttgtggcttatgtggagtttacatgggcctctgatggaagaaagctaatctgtttagtatttgtgcattttactaaaatggca

SEQ ID NO: 297972 - DNA, 1008 bp, Homo sapiens
agcatggcatggatcacagccggctttaactcggtcacagggcagatgtgttaaggtacagtggtcccttcgatcacagctgatattagccggatcgggcacgggtctccgaccaggtgagttatggaccagctcactggattgctagtctatactcatttgtcagtccatacacacaactaaagctctgacaacatgtggcctattaccctggctactagacaggtgaccctgctgcctacagacagtcaatgattccggccctgccttcacaaagtgagcggacagagtgaaaaatgtctcaaattgggtataacaaatcagcgtgattgcctttcacctccactttggagtgctttgagccagtttggacacaaggaggttggagttaaaatgactcctgaaggaagtaagcaagcatgagaagagagggcagcactgtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacag

SEQ ID NO: 297973 - DNA, 326 bp, Homo sapiens
tgtttttagactttttttgcgtttgaaaatgtgttttttgaggtggaatacccaactgacccctcatctctcctctctctctgctgccctgcagtgctacagttgaaactccagcagcgccggacccgggaagaactggtgagccaagggatcatgccgcgtaagtgcctctctctctcagcatttggtagattgcttttaggacatggctgtgttcaccgagtatgccatgggaagcatctaacataaaacaaggatgatgcgttttattttccactctcttctttctcatgactttccaagtttagagctcaatcactaaatag

SEQ ID NO: 297974 - DNA, 4504 bp, Homo sapiens
gctgagaggagccggcggcggcagtgtctgtggtggccgcggcggcgagagcgacggtcccatctttcccaccctcttggttgccgctggccacacgccctccgctggcggcgacttctcagctccgtgcgcccgggctggacagtgagcctcgagaggagacgcgggcggctagagccggagtggggcgagccgcggaacccggccgggagccgcgcgaggcgtgatcggagggtatggttggcatggaattgaatttcatctgtctgtgggaattgtaagcaagattgccatcacgaaagccaaagtggatttctccagtgtggtgtgcctgcccccttccgtcattgctgtgaatgggctggacggaggaggggccggcgaaaatgatgatgaaccagtgctcgtgtccttatctgcggcacccagtccccagagtgaagctgttgccaatgaactgcaggagctctccttgcagcccgagctgaccctaggcctccaccctggcaggaatcccaatttgcctccacttagtgagcggaagaatgtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacag

SEQ ID NO: 297975 - DNA, 6849 bp, Homo sapiens
tgagactgtagaagagagagcaattggccaatgaggactgcggggcgggaccctgtgccgcggcggagtccaagatggcggcgtgcggttccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctccacctggacaagtccagcagtcgaggtggcagccgcgagtatgataccggtgggggcagctccagtagccgcttgcatagttatagctccccgagcaccaaaaattcttcgggcgggggcgagtcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaagagactacccgttctatgagagagtgcgccctgcatacagtcttgagccaagggtgggagctggagcaggtgctgctcctttcagagaagtggatgagatttcacccgaggatgatcagcgagctaaccggacgctcttcttgggcaacctagacatcactgtaacggagagtgatttaagaagggcgtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaagctacacccaccacccgcctctgggtgggaggcctgggaccttgggttcctcttgctgccctggcacgagaatttgatcgatttggcaccatacgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttacgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacagacgaggtagtttggagaagagccagggtgacaagcgagaccgtaaaaactctgcatcagctgaacgagataggaagcaccggacaactgctcccactgagggaaaaagccctctgaaaaaagaagaccgctctgatgggagtgcacctagcaccagcactgcttcctccaagctgaagtccccgtcccagaaacaggatggggggacagcccctgtggcatcagcctctcccaaactctgtttggcctggcagggcatgcttctactgaagaacagcaactttccttccaacatgcatctgttgcagggtgacctccaagtggctagtagtcttcttgtggagggttcaactggaggcaaagtggcccagctcaagatcactcagcgtctccgtttggaccagcccaagttggatgaagtaactcgacgcatcaaagtagcagggcccaatggttatgccattcttttggctgtgcctggaagttctgacagccggtcctcctcttcctcagctgcatcagacactgccacttctactcagaggccacttaggaaccttgtgtcctatttaaagcaaaagcaggcagccggggtgatcagcctccctgtggggggcaacaaagacaaggaaaacaccggggtccttcatgccttcccaccttgtgagttctcccagcagttcctggattcccctgccaaggcactggccaaatctgaagaagattacctggtcatgatcattgtccgtgtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacag

SEQ ID NO: 297976 - DNA, 4247 bp, Homo sapiens
ggattgtaagctggattgacataacgacaggactaaagctgagactaggcttaaggtggggcgatgtcctgtcctcttcgcgctctatagctgtgacacgggggctggacggaggaggggccggcgaaaatgatgatgaaccagtgctcgtgtccttatctgcggcacccagtccccagagtgaagctgttgccaatgaactgcaggagctctccttgcagcccgagctgaccctaggcctccaccctggcaggaatcccaatttgcctccacttagtgagcggaagaatgtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacag

SEQ ID NO: 297977 - DNA, 4328 bp, Homo sapiens
gctgagaggagccggcggcggcagtgtctgtggtggccgcggcggcgagagcgacggtcccatctttcccaccctcttggttgccgctggccacacgccctccgctggcggcgacttctcagctccgtgcgcccgggctggacagtgagcctcgagaggagacgcgggcggctagagccggagtggggcgagccgcggaacccggccgggagccgcgcgaggcgtgatcggagggtatggttggcatggaattgaatttcatctgtctgtgggaattgtaagcaagattgccatcacgaaagccaaagtggatttctccagtgtggtgtgcctgcccccttccgtcattgctgtgaatgggctggacggaggaggggccggcgaaaatgatgatgaaccagtgctcgtgtccttatctgcggcacccagtccccagagtgaagctgttgccaatgaactgcaggagctctccttgcagcccgagctgaccctaggcctccaccctggcaggaatcccaatttgcctccacttagtgagcggaagaatgtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcgggacccccccagtacgcagcctctccactaccaatagcagctccagctcgggcgcccctgggccctgtgggctggcacgtcagaacagcacctcactgactggcaagccgggagccctgccggccaacctggacgacatgaaggtggcagagctgaagcaggagctgaagttgcgatcactgcctgtctcgggcaccaaaactgagctgattgagcgccttcgagcctatcaagaccaaatcagccctgtgccaggagcccccaaggcccctgccgccacctctatcctgcacaaggctggcgaggtggtggtagccttcccagcggcccggctgagcacggggccagccctggtggcagcaggcctggctccagctgaggtggtggtggccacggtggccagcagtggggtggtgaagtttggcagcacgggctccacgccccccgtgtctcccaccccctcggagcgctcactgctcagcacgggcgatgaaaactccacccccggggacacctttggtgagatggtgacatcacctctgacgcagctgaccctgcaggcctcgccactgcagatcctcgtgaaggaggagggcccccgggccgggtcctgttgcctgagccctggggggcgggcggagctagaggggcgcgacaaggaccagatgctgcaggagaaagacaagcagatcgaggcgctgacgcgcatgctccggcagaagcagcagctggtggagcggctcaagctgcagctggagcaggagaagcgagcccagcagcccgcccccgcccccgcccccctcggcacccccgtgaagcaggagaacagcttctccagctgccagctgagccagcagcccctgggccccgctcacccattcaaccccagcctggcggccccagccaccaaccacatagacccttgtgctgtggccccggggcccccgtccgtggtggtgaagcaggaagccttgcagcctgagcccgagccggtccccgccccccagttgcttctggggcctcagggccccagcctcatcaagggggttgcacctcccaccctcatcaccgactccacagggacccaccttgtcctcaccgtgaccaataagaatgcagacagccctggcctgtccagtgggagcccccagcagccctcgtcccagcctggctctccagcgcctgccccctctgcccagatggacctggagcacccactgcagcccctctttgggacccccacttctctgctgaagaaggaaccacctggctatgaggaagccatgagccagcagcccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacag

SEQ ID NO: 297978 - DNA, 1744 bp, Homo sapiens
gcagatcaggccgggggtattcggacgaggtataggaagccattgagcagcagccaaacagcaggaaaatggttcctcaagccagcagatggacgacctgtttgacattctcattcagagcggagaaatttcagcagatttcaaggagccgccatccctgccagggaaggagaagccatccccgaagacagtctgtgggtcccccctggcagcacagccatcaccttctgctgagctcccccaggctgccccacctcctccaggctcaccctccctccctggacgcctggaggacttcctggagagcagcacggggctgcccctgctgaccagtgggcatgacgggccagagcccctttccctcattgacgacctccatagccagatgctgagcagcactgccatcctggaccaccccccgtcacccatggacacctcggaattgcactttgttcctgagcccagcagcaccatgggcctggacctggctgatggccacctggacagcatggactggctggagctgtcgtcaggtggtcccgtgctgagcctagcccccctcagcaccacagcccccagcctcttctccacagacttcctcgatggccatgatttgcagctgcactgggattcctgcttgtagctctctggctcaagacggggtggggaaggggctgggagccagggtactccaatgcgtggctctcctgcgtgattcggcctctccacatggttgtgagtcttgacaatcacagcccctgctttttcccttccctgggaggctagaacagagaagcccttactcctggttcagtgccacgcagggcagaggagagcagctgtcaagaagcagccctggctctcacgctggggttttggacacacggtcagggtcagggccatttcagcttgacctccttttttgaggtcagggggcactgtctgtctggctacaatttggctaaggtaggtgaagcctggccaggcgggaggcttctcttctgacccagggctgagacaggttaaggggtgaatctccttcctttctctccctgctttgctgtgaagggagaaattagcctgggcctctaccccctattccctgtgtctgccaaccccaggatcccagggctccctgccattttagtgtcttggtgtagtgtaaccatttagtggttggtggcaacaattttatgtacaggtgtatatacctctatattatatatcgacatacatatatatttttgggggggggcggacaggagatgggtgcaactccctcccatcctactctcacagaagggcctggatgcaaggttacccttgagctgtgtgccacagtctggtgcccagtctggcatgcagctacccaggcccacccatcacgtgtgattgacatgtaggtaccctgccacggcctatgccccacctgccctgcttcctggctccttatcagtgccatgagggcagaggtgctacctggccttcctgccaggagctctccacccactcacattccgtccccgccgcctcactgcagccagcgtggccctaggacaggaggagcttcgggcccagcttcaccctgcggtggggctgaggggtggccatctcctgccctggggccactggcttcacattctgggctgactcataggggagtaggggtggagtcaccaaaaccagtgctgggacaaagatggggaaggtgtgtgaactttttaaaataaacacaaaaacacag

SEQ ID NO: 297979 - DNA, 1572 bp, Homo sapiens
gctgagaggagccggcggcggcagtgtctgtggtggccgcggcggcgagagcgacggtcccatctttcccaccctcttggttgccgctggccacacgccctccgctggcggcgacttctcagctccgtgcgcccgggctggacagtgagcctcgagaggagacgcgggcggctagagccggagtggggcgagccgcggaacccggccgggagccgcgcgaggcgtgatcggagggtatggttggcatggaattgaatttcatctgtctgtgggaattgtaagcaagattgccatcacgaaagccaaagtggatttctccagtgtggtgtgcctgcccccttccgtcattgctgtgaatgggctggacggaggaggggccggcgaaaatgatgatgaaccagtgctcgtgtccttatctgcggcacccagtccccagagtgaagctgttgccaatgaactgcaggagctctccttgcagcccgagctgaccctaggcctccaccctggcaggaatcccaatttgcctccacttagtgagcggaagaatgtgctacagttgaaactccagcagcgccggacccgggaagaactggtgagccaagggatcatgccgcctttgaaaagtccagccgcatttcatgagcagagaaggagcttggagcgggccaggacagaggactatctcaaacggaagattcgttcccggccggagagatcggagctggtcaggatgcacattttggaagagacctcggctgagccatccctccaggccaagcagctgaagctgaagagagccagactagccgatgacctcaatgagaagattgcacagaggcctggccccatggagctggtggagaagaacatccttcctgttgagtccagcctgaaggaagccatcattgtgggccaggtgaactatcccaaagtagcagacagctcttccttcgatgaggacagcagcgatgccttatcccccgagcagcctgccagccatgagtcccagggttctgtgccgtcacccctggaggcccgagtcagcgaaccactgctcagtgccacctctgcatcccccacccaggttgtgtctcaacttccgatgggccgggattccagagaaatgcttttcctggcagagcagcctcctctgcctcccccacctctgctgcctcccagcctcaccaatggaaccactatccccactgccaagtccacccccacactcattaagcaaagccaacccaagtctgccagtgagaagtcacagcgcagcaagaaggccaaggagctgaagccaaaggtgaagaagctcaagtaccaccagtacatccccccggaccagaagcaggacaggggggcaccccccatggactcatcctacgccaagatcctgcagcagcagcagctcttcctccagctgcagatcctcaaccagcagcagcagcagcaccacaactaccaggccatcctgcctgccccgccaaagtcagcaggcgaggccctgggaagcagcagcctccctctttatcgccatcctgcaagctacacagcccgcggcctgtaagctga

SEQ ID NO: 297980 - DNA, 1146 bp, Homo sapiens
gctgagaggagccggcggcggcagtgtctgtggtggccgcggcggcgagagcgacggtcccatctttcccaccctcttggttgccgctggccacacgccctccgctggcggcgacttctcagctccgtgcgcccgggctggacagtgagcctcgagaggagacgcgggcggctagagccggagtggggcgagccgcggaacccggccgggagccgcgcgaggcgtgatcggagggtatggttggcatggaattgaatttcatctgtctgtgggaattgtaagcaagattgccatcacgaaagccaaagtggatttctccagtgtggtgtgcctgcccccttccgtcattgctgtgaatgggctggacggaggaggggccggcgaaaatgatgatgaaccagtgctcgtgtccttatctgcggcacccagtccccagagtgaagctgttgccaatgaactgcaggagctctccttgcagcccgagctgaccctaggcctccaccctggcaggaatcccaatttgcctccacttagtgagcggaagaatgtgctacagttgaaactccagcagcgccggacccgggaagaactggtgagccaagggatcatgccgcgtaagtgcctctctctctcagcatttggtagattgcttttaggacatggctgtgttcaccgagtatgccatgggaagcatctaacataaaacaagaatgaatgaagacagccagttgtaaagtacagtgtgtgcatgtgtatatgagagagagagtctgacaaactgaaatagataccgctctattgaaaacctgttggaattctgggcatggagtttgaaacaacactcccattctgtcaggagcccggattctaaaattgtcctgaatatctaattgtatactttgggttgttctctgtgtctgtgaagtgagaataattgcctttcctgtgggaatagaaatgacctgcttctatgagaatattgcattttcccatataccaagatccaccttcagctatggacatagtcttgttatcagcttttctagagaaggaagtaggtaagaaatgcttagattatgagagagaatgttgaggactgggaatagtttcaggtgtgaatttcctcctcatttacgtccctgttgg

SEQ ID NO: 297981 - DNA, 875 bp, Homo sapiens
gctgagaggagccggcggcggcagtgtctgtggtggccgcggcggcgagagcgacggtcccatctttcccaccctcttggttgccgctggccacacgccctccgctggcggcgacttctcagctccgtgcgcccgggctggacagtgagcctcgagaggagacgcgggcggctagagccggagtggggcgagccgcggaacccggccgggagccgcgcgaggcgtgatcggagggtatggttggcatggaattgaatttcatctgtctgtgggaattgtaagcaagattgccatcacgaaagccaaagtggatttctccagtgtggtgtgcctgcccccttccgtcattgctgtgaatgggctggacggaggaggggccggcgaaaatgatgatgaaccagtgctcgtgtccttatctgcggcacccagtccccagagtgaagctgttgccaatgaactgcaggagctctccttgcagcccgagctgaccctaggcctccaccctggcaggaatcccaatttgcctccacttagtgagcggaagaatgtgctacagttgaaactccagcagcgccggacccgggaagaactggtgagccaagggatcatgccgcggtttggttttcagataggagttaggtatgagaacaagaagagagaaaacttggcgctgaccctgttatagtggttatagtggtgtccctaaagggaggaaatgatttcagcaaaactggttgaacagcggatgaagatatggaattcaaagctctaatggacctttttgaagagaagttgtggcttatgtggagtttacatgggcctctgatggaagaaagctaatctgtttagtatttgtgcattttactaaaatggca

SEQ ID NO: 297982 - DNA, 879 bp, Homo sapiens
ccgaggaaaaccgtgtgctattagccatggtcaaccccaccgtgttcttcgacattgccgtcgacgggagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatcttgtgctctcgctgcagttccctttgggttccatgttttccttgttccctcccatgcctagctggattgcagagttaagtttatgattatgaaataaaataatacaaaaaaaaaggggggcgtcaaaattccttgagggccagtacgtccagttctgtaaggccaaagggcggaaaagaaggaggggcgcgtaagcggtggcaacgctggcttgggaaggaccctggggcatggacacaaaagtgaaaaaagtggaagttgg

SEQ ID NO: 297983 - DNA, 657 bp, Homo sapiens
  misc_feature (607)..(607): n is a, c, g, or t
  misc_feature (613)..(613): n is a, c, g, or t
ccgaggaaaaccgtgtgctattagccatggtcaaccccaccgtgttcttcgacattgccgtcgacgggagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccattagccacccgangagccncaccaagagcacgcgaagagccacacaaagcgccgcacaaagag

SEQ ID NO: 297984 - DNA, 414 bp, Homo sapiens
  misc_feature (364)..(364): n is a, c, g, or t
  misc_feature (370)..(370): n is a, c, g, or t
tttcttcttgtaggtcgatgaggtgatgctgactctcaaacaggctttcagtacggccgctgccctgcagagtgccaagacccagattaagctgtgcgaggcctgccctatgcactctttgcataagctctgtgaacggattgaaggtcaccgtatcagttggccttggccaaacaagagtttgctttggcatttggacgcgtttgcgacacgctttgggtccaggaatggcaagaccagcaagaagatcaccattgctgactgtggacaactcgaataagtttgacttgtgttttatcttaaccaccagatcattccttctgtagctcaggagagcacccctccaccccattagccacccgangagccncaccaagagcacgcgaagagccacacaaagcgccgcacaaagag

SEQ ID NO: 297985 - DNA, 191 bp, Homo sapiens
gaaaaccgtgtgctattagccatggtcaaccccaccgtgttcttcgacattgccgtcgacgggagcccttgggccgcgtctcctttgaggtaaggggcctggaaaccaagaagtgactgctcatctaatccataaagctatgttaacagattggagctgtttgcagacaaggtcccaaagacagcagaaaa

SEQ ID NO: 297986 - DNA, 1727 bp, Homo sapiens
cggtagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaagcgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgagg

SEQ ID NO: 297987 - DNA, 587 bp, Homo sapiens
ccggcggcgcatggacggtcttctagggcccaggtcagggggcttgacttctggccccttgtagaatttcctgaggttttctttctgagtctggttaataactgtgagaacacggcaaatggatttccggacgactcggatcttaaagagcttggaggccgcaccgcctgtcactttggcgacgcgcagctgggacagctccaccttcaggtcgtccagctgtttcagcagctcctcctttttcttcccgcgaagatctcgagccttgattttggccattgctgcacaaaccgccaacatctttactggtgaaaaggatggaaaaataaatcaacaaatgcaaccagtttgtgagaaaaaaaaaaaaaagccgaaaaaaaaaaaaaaaacacctgaatgcggaagagctcggctcccgtttagcattttgtacttaaggaaataaaaaaccaacaaaggatctcacattttcttaaaaagtgaagattgctgtatactatttattcaacttataatttatgttactccttgatctttgtcttttgtcatgacaaagcatttatttaataaagttatgcattcagtta

SEQ ID NO: 297988 - DNA, 6009 bp, Homo sapiens
cggtagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaagcgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgag

SEQ ID NO: 297989 - DNA, 5956 bp, Homo sapiens
cggtagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcatgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaagcgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgag

SEQ ID NO: 297990 - DNA, 5947 bp, Homo sapiens
cggtagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaagcgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgag

SEQ ID NO: 297991 - DNA, 3959 bp, Homo sapiens
tatcgatgccacccacaggacacaaacaagctcacccaacaaagccaaccgtggactagtgagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgag

SEQ ID NO: 297992 - DNA, 6241 bp, Homo sapiens
cggtagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaagcgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgagaaaaaaaaaaaaaagccgaaaaaaaaaaaaaaaacacctgaatgcggaagagctcggctcccgtttagcattttgtacttaaggaaataaaaaaccaacaaaggatctcacattttcttaaaaagtgaagattgctgtatactatttattcaacttataatttatgttactccttgatctttgtcttttgtcatgacaaagcatttatttaataaagttatgcattcagtta

SEQ ID NO: 297993 - DNA, 6564 bp, Homo sapiens
cggtagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaagcgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgagaaaaaaaaaaaaaagccgaaaaaaaaaaaaaaccctgtgtagtgggggaagagagctcgcggccccgcgttaaagccttgggcgcttagggaattaaaaaccccacagaggggtcctcacttttttcttaaacaagggggacagaagtggcggtattccctattttatcccacgcttatctaattgtgttaccccctgggaaatcttgggccttgtgtctgtgcacaagcgctttcttcaagccaacgggtttgggcttttcgcgggacaaaaaaaaagcacagaactcacaccaaaaacaacactgtgttggcggggcgcgacgcgccacggaaaaaaggctttttaaaaaacacactcgtggggggcgcggggccgcccactggtgtatacagtgaacacgtgctcacaaggcgtgcccaggagacaccggtggtccagcaacgtgcggtgggtctcccaccaataaaaaagcgcccgcgggggacccggcggggtttgaccacctcagggggggtccgggccaatccggcttcacccggggcccggggcgaa

SEQ ID NO: 297994 - DNA, 6308 bp, Homo sapiens
cggtagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaagcgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgagaaaaaaaaaaaaaagccgaaaaaaaaaaaaaaggggcggccgcccttttttttttttttttttttttaacgcttaatacactttatttttttggaataaaaaccctatgttgtagccacagctggagcctgagtccgctgcacggaaactctggtgtgggtcttgacaaggtggtcaatgaactcctgatagggagacttggtgaatacagtctccttccaaaggtcgggggtcaggtagctgtaggtcttaaaaatggcatcaaaggtggccttggcgaatatgcccagtgtggtagt

SEQ ID NO: 297995 - DNA, 3870 bp, Homo sapiens
tgatcttcctgccctaactctattcgtctttctctctcttctacacaaacacttccttcccttctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgag

SEQ ID NO: 297996 - DNA, 3475 bp, Homo sapiens
accattgatagtgcacacggcattgagagtgcacacgggcatgagagtgatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgag

SEQ ID NO: 297997 - DNA, 3154 bp, Homo sapiens
cacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgag

SEQ ID NO: 297998 - DNA, 6197 bp, Homo sapiens
cggtagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaagcgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataacccttccaccagcacggcaaaggatgcgtgggactatgtaaacggcgccagggggctgaaggccactcgcaatgggaggagacaagcgggctcgaggacttacgctggaaggccgttggtgtgagcatattttctccgggctcccaaaagtgtacgacacgctgatgcagatgggacgggggtccggctatcgacggggttactgggactggtgtcgtctctacaccacgagggatcgggtggatgggtccgagcacttggccgacgcaggggaagagtggcgagccgaatccgacttcatgaaagatagcgggctgaccccacgtcagtatgctggggggaagggagggggatc

SEQ ID NO: 297999 - DNA, 2841 bp, Homo sapiens
gcgttcccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgag

SEQ ID NO: 298000 - DNA, 2702 bp, Homo sapiens
ccaccttgctgcttagtcgccccctttaccctggctagacccagggtaaagggggcgactaaggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgag

SEQ ID NO: 298001 - DNA, 1921 bp, Homo sapiens
ccccaggggaaaacagcctattgacacattgattacgggaattgcggagcttcgggtagcccgtacgggatagctggccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggccccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctgctcccgccacgcaccggttagtgagacagggctgccacggcaaccgccaagcccccctcaaggtgggacagtaccccggacccatccactcactcctgagagggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgag

SEQ ID NO: 298002 - DNA, 5009 bp, Homo sapiens
cggtagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaagcgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgagaaaaaaaaaaaaaagccgaaaaaaaaaaaaaaaacacctgaatgcggaagagctcggctcccgtttagcattttgtacttaaggaaataaaaaaccaacaaaggatctcacattttcttaaaaagtgaagattgctgtatactatttattcaacttataatttatgttactccttgatctttgtcttttgtcatgacaaagcatttatttaataaagttatgcattcagtta

SEQ ID NO: 298003 - DNA, 4904 bp, Homo sapiens
cggtagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaagcgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctggcctttggccgactgtctgctcacccagagaccttggactccggactatccatggtcccgtttagcattttgtacttaaggaaataaaaaaccaacaaaggatctcacattttcttaaaaagtgaagattgctgtatactatttattcaacttataatttatgttactccttgatctttgtcttttgtcatgacaaagcatttatttaataaagttatgcattcagtta

SEQ ID NO: 298004 - DNA, 4657 bp, Homo sapiens
cggtagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaagcgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtaaaaaaaaaaaaaagccgaaaaaaaaaaaaaaaacacctgaatgcggaagagctcggctcccgtttagcattttgtacttaaggaaataaaaaaccaacaaaggatctcacattttcttaaaaagtgaagattgctgtatactatttattcaacttataatttatgttactccttgatctttgtcttttgtcatgacaaagcatttatttaataaagttatgcattcagtta

SEQ ID NO: 298005 - DNA, 3551 bp, Homo sapiens
cggtagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaagcgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggttccctgtgcccgctcaccccactccaccagtccccggtcgccagccggagtctcctctctaccgccactgtcacaccgtagcccacatggatagcacagttgtcagacaagattccttcagattccgagttgcctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgag

SEQ ID NO: 298006 - DNA, 4115 bp, Homo sapiens
cggtagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaagcgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatagggccagcagccacaaggccttgacctgccgagtcagcatgccccatctctctgcacagctgtcgggctagtcggggactgtcgggctagtcggggactgtcgggctagtcggggggtacctagctcgattcc

SEQ ID NO: 298007 - DNA, 3830 bp, Homo sapiens
cggtagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaagcgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacatgagcccaacaggtccacgatggatccaccagtcccaccccagccttttcctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttctaggatttgagaggaaagagaggaaaatgggggaatgggttgcaaaatagaaatgagcttaatccaggccgcagagccagggaaggtgagtaactttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatgtcatgacaaagcatttatttaataaagttatgcattcagtta

SEQ ID NO: 298008 - DNA, 3031 bp, Homo sapiens
cggtagtctctttggaaacttctgcaggggaaaagagctaggaaagagctgcaaagcagtgtgggctttttcccttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaagcgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaactgaggacctcggaatctctagcaagggctcaacttcgaaaatggcaacaacagagatgcaaaaagctaaaaagacaccccccccctttaaatggttttctttttgaggcaagttggatgaacagagaagggaagagaggaagaacgagaggaagagaagggaaggaagtgtttgtgtagaagagagagaaagacgaatagagttaggaaaaggaagacaagcaggtgggcaggaaggacatgcaccgagaccaggcaggggcccaactttcacgtccagccctggcctggggtcgggagaggtgggcgctagaagatgcagcccaggatgtggcaatcaatgacactattggggtttcccaggatggattggtcagggggagaaaggaaaaggcaaaacactccaggacctctcccggatctgtctcctcctctagccagcagtatggacagctggacccctgaacttcctctcctcttacctgggcagagtgttgtctctccccaaatttataaaaactaaaatgcattccattcctctgaaagcaaaacaaattcataattgagtgatattaaatagagaggttttcggaagcagatctgtgaatatgaaatacatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcagcagcctctgtgggggaggataggctgaaaaaaaaaagtgggctcgtatttatctacaggactccatatagtcatatataggcatataaatctattctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcgtaaatctatcagatgaggatctgcctagagatagggagtgggaaggacctctcaaacaagaatagatgacaacttctgtcagagcaggacagcagcgat

SEQ ID NO: 298009 - DNA, 798 bp, Homo sapiens
  misc_feature (612)..(612): n is a, c, g, or t
ggccaagttatgaggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagctgaagaaaatgaaaaagaaaaaaaaaaanttggggggcgcgcgggccgggaagaacttttcaaccctcgcggtgggggcgggggccaggggtaagggcaatggcacagggtgccaaggacaccggccgcacagggggggtttccccaaaaaaacgccgggggcccgggttcgacaacacccacggtcgggcgtcaggttacacagcgccggctat

SEQ ID NO: 298010 - DNA, 2790 bp, Homo sapiens
cccccgggctgcaggattcggcacgtgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatcc

SEQ ID NO: 298011 - DNA, 2800 bp, Homo sapiens
  misc_feature (30)..(30): n is a, c, g, or t
  misc_feature (33)..(33): n is a, c, g, or t
tctgattcctcggagcatgttggcctactnggnagtgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatcc

SEQ ID NO: 298012 - DNA, 2701 bp, Homo sapiens
gcggccgctccaacatcagaatggtcaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatcc

SEQ ID NO: 298013 - DNA, 2253 bp, Homo sapiens
ggccaagttatgaggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcaggtatgaagcaagcggaaagctggtttttaatgaagacgaagaaggtcgcaaattccgtgggggttgggggggaacctagatgttaatgggggtagaaatacacgattgtcggaggggatgaagatacaagatagtaacttaagaacacgatatgtgaagaacatggtgaaggaacatggcgggaaactattttcttttgtattcg

SEQ ID NO: 298014 - DNA, 1768 bp, Homo sapiens
ggccaagttatgaggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgat

SEQ ID NO: 298015 - DNA, 1581 bp, Homo sapiens
ggccaagttatgaggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaacc

SEQ ID NO: 298016 - DNA, 2971 bp, Homo sapiens
ggccaagttatgaggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaaggccataagatgttttattgaaagaaactttcaatatcaagtaatccaaccaaccttctaagataagccttttccttcaacacaaagaagtgcattttgccaaatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatcc

SEQ ID NO: 298017 - DNA, 2530 bp, Homo sapiens
ggccaagttatgaggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatcc

SEQ ID NO: 298018 - DNA, 2472 bp, Homo sapiens
agctcggtaccccctggctctgaacttagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatcc

SEQ ID NO: 298019 - DNA, 2290 bp, Homo sapiens
ggctcggcccagtctgttctacatcacagcagtatccacagaagatgatccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatcc

SEQ ID NO: 298020 - DNA, 2309 bp, Homo sapiens
ctcaaaattgaggagcaaagagaaaaagtacatgaaaatgaaaatataggtaccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatcc

SEQ ID NO: 298021 - DNA, 2005 bp, Homo sapiens
ggccaagttatgaggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagcgtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatcc

SEQ ID NO: 298022 - DNA, 1010 bp, Homo sapiens
ggccaagttatgaggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccgggatcctcagactcgaccgtcgagc

SEQ ID NO: 298023 - DNA, 1786 bp, Homo sapiens
agctcgcatgcgtgtagagggagactatagaagacccgcgagcagaacacgcgcaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatcc

SEQ ID NO: 298024 - DNA, 1808 bp, Homo sapiens
ctgcggtgatgatggtgatggtgatggtgatgatgatgatggtgatggtgattatggtgatgatggtgatgacaaaaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatcc

SEQ ID NO: 298025 - DNA, 1926 bp, Homo sapiens
tgggtcgacttgaggatccccgtgaaagcacaccgctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatcc

SEQ ID NO: 298026 - DNA, 1551 bp, Homo sapiens
ctctagaggatctgactgcatctgtgcctctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatcc

SEQ ID NO: 298027 - DNA, 562 bp, Homo sapiens
  misc_feature (466)..(466): n is a, c, g, or t
  misc_feature (489)..(489): n is a, c, g, or t
  misc_feature (498)..(498): n is a, c, g, or t
  misc_feature (546)..(546): n is a, c, g, or t
  misc_feature (559)..(559): n is a, c, g, or t
ggccaagttatgaggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgctccctggggcaattctgtctttctntcttgggttatcattgtgggtancaacttcanctgggctctttttcttcttcctcttctccattggaaatatttgtcgangcggccggaaatntta

SEQ ID NO: 298028 - DNA, 451 bp, Homo sapiens
ggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggtaaaattattttaaatggtcc

SEQ ID NO: 298029 - DNA, 2869 bp, Homo sapiens
ggccaagttatgaggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatcc

SEQ ID NO: 298030 - DNA, 3897 bp, Homo sapiens
ggaaacctaacgtcaaagtctacgtaggaagtcgtagggaaggcagcgaggaagacgctggctctcgggtcacgtgatgcgccgggagcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactctaaaagacactaaattgtactaattgtacaaaggtcaagccaattttatgaaacagtcctacagagtaatatatgtgatgcagtgtaagaaggaaaatactcatctctaacattatggtaataacatttagcctcttaggagttggagcagggggatgggtaattacagatttgcagactatagaaagagtttcatttttttgtgaccccacagagtctcaaatttttatttcactacctgctagagcctactgtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgtgaagaaacaccctttttggtcccttttgggacagagaggtactccttgatctttatgaatgacaggttactgttttgccttattgcttaacttaatgtagtgaaataaagcagacaaagcttg

SEQ ID NO: 298031 - DNA, 2218 bp, Homo sapiens
ccacgcgtccggtgcagggttcagtgagggagacacagacttactggtgtcaacaggggtgagagcagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactctaaaagacactaaattgtactaattgtacaaaggtcaagccaattttatgaaacagtcctacagagtaatatatgtgatgcagtgtaagaaggaaaatactcatctctaacattatggtaataacatttagcctcttaggagttggagcagggggatgggtaattacagatttgcagactatagaaagagtttcatttttttgtgaccccacagagtctcaaatttttatttcactacctgctagagcctactgtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgtgaagaaacaccctttttggtcccttttgggacagagaggtactccttgatctttatgaatgacaggttactgttttgccttattgcttaacttaatgtagtgaaataaagcagacaaagcttg

SEQ ID NO: 298032 - DNA, 2821 bp, Homo sapiens
ggaaacctaacgtcaaagtctacgtaggaagtcgtagggaaggcagcgaggaagacgctggctctcgggtcacgtgatgcgccgggagcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgttt

SEQ ID NO: 298033 - DNA, 3280 bp, Homo sapiens
ggaaacctaacgtcaaagtctacgtaggaagtcgtagggaaggcagcgaggaagacgctggctctcgggtcacgtgatgcgccgggagcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacaccttaaaaatg

SEQ ID NO: 298034 - DNA, 396 bp, Homo sapiens
cggacgcgtgggtcgacccacgcgtcgcccacgcgtccgctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgtgaagaaacaccctttttggtcccttttgggacagagaggtactccttgatctttatgaatgacaggttactgttttgccttattgcttaacttaatgtagtgaaataaagcagacaaagcttg

SEQ ID NO: 298035 - DNA, 1293 bp, Homo sapiens
ggaaacctaacgtcaaagtctacgtaggaagtcgtagggaaggcagcgaggaagacgctggctctcgggtcacgtgatgcgccgggagcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtaacagagtcgccctatagcgagtatgtggggtggggggggcgcggcgttcatgctagtcactgccaccggaaggctggagctattttccttccttactgatggcttagagcttacggaattcgggttcaccagtgacgaaggtcgctactcatcagcacctttggaagccacaggcttctccgtactgaccggactattgtctcggcttctctgactacttggatcggccgccaattagtaaggcactctactgtgcatgcctcctttcgcttaaacgggctcacctctcccgcagctctggggatggctctgctctctaggacgccccaaggttcgttacgcatcactggtagctgctagagcgtcacgcctcaacgcattaacccccctccctagcctggcccttgcgcctctcactccgccgctctacacccaccgcctatctggctcctgctcggctctacccggaaccgccccaccagtccgggtccaccccggaccacgttccctcccatctcctcctatactgtcctctccgcagcacgcctgtcccactaccaccctgcgctggcgtccagcctctgtccactccttcctctccccccctcccacctcctggctccaccccttgttattgccatgaatctctcgccccctattctcgctgcaccgactctctcccaacagggcctctacctcataccctctctctaacgcactccgctaactcaggcgcttccgcccatcactcccttctggctccctcctctatcccctccgcgctctctgtccccgtctctcctcgcgttccctaccgtctccgcacctctccagacgtctcctccccttcgattccgccactcatctctccctcgatctcgtcctcatctgtcaccgcttgtgcctccacatactccccaccggttttccccgctatctcctctcttctcacatcgacccgccgctcatctctctcactcctccgcacactgcctcagtctctcatcacactacgtccatctcacccttctccttctctccg

SEQ ID NO: 298036 - DNA, 3785 bp, Homo sapiens
cccagtgtgaacgattgtgggtgtgggtgagtctgctctgcgatgtgatggcgtcctgtccagggctggttactgcctcgagccctgagctgccgggacaggctctggccactgaactctaaactggaataagcaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactctaaaagacactaaattgtactaattgtacaaaggtcaagccaattttatgaaacagtcctacagagtaatatatgtgatgcagtgtaagaaggaaaatactcatctctaacattatggtaataacatttagcctcttaggagttggagcagggggatgggtaattacagatttgcagactatagaaagagtttcatttttttgtgaccccacagagtctcaaatttttatttcactacctgctagagcctactgtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgtgaagaaacaccctttttggtcccttttgggacagagaggtactccttgatctttatgaatgacaggttactgttttgccttattgcttaacttaatgtagtgaaataaagcagacaaagcttg

SEQ ID NO: 298037 - DNA, 3853 bp, Homo sapiens
ggaaacctaacgtcaaagtctacgtaggaagtcgtagggaaggcagcgaggaagacgctggctctcgggtcacgtgatgcgccgggagcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactctaaaagacactaaattgtactaattgtacaaaggtcaagccaattttatgaaacagtcctacagagtaatatatgtgatgcagtgtaagaaggaaaatactcatctctaacattatggtaataacatttagcctcttaggagttggagcagggggatgggtaattacagatttgcagactatagaaagagtttcatttttttgtgaccccacagagtctcaaatttttatttcactacctgctagagcctactgtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgtgaagaaacaccctttttggtcccttttgggacagagaggtactccttgatctttatgaatgacaggttactgttttgccttattgcttaacttaatgtagtgaaataaagcagacaaagcttg

SEQ ID NO: 298038 - DNA, 3843 bp, Homo sapiens
ggaaacctaacgtcaaagtctacgtaggaagtcgtagggaaggcagcgaggaagacgctggctctcgggtcacgtgatgcgccgggagcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactctaaaagacactaaattgtactaattgtacaaaggtcaagccaattttatgaaacagtcctacagagtaatatatgtgatgcagtgtaagaaggaaaatactcatctctaacattatggtaataacatttagcctcttaggagttggagcagggggatgggtaattacagatttgcagactatagaaagagtttcatttttttgtgaccccacagagtctcaaatttttatttcactacctgctagagcctactgtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgtgaagaaacaccctttttggtcccttttgggacagagaggtactccttgatctttatgaatgacaggttactgttttgccttattgcttaacttaatgtagtgaaataaagcagacaaagcttg

SEQ ID NO: 298039 - DNA, 4046 bp, Homo sapiens
ggaaacctaacgtcaaagtctacgtaggaagtcgtagggaaggcagcgaggaagacgctggctctcgggtcacgtgatgcgccgggagcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactctaaaagacactaaattgtactaattgtacaaaggtcaagccaattttatgaaacagtcctacagagtaatatatgtgatgcagtgtaagaaggaaaatactcatctctaacattatggtaataacatttagcctcttaggagttggagcagggggatgggtaattacagatttgcagactatagaaagagtttcatttttttgtgaccccacagagtctcaaatttttatttcactacctgctagagcctactgtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgtgaagaaacaccctttttggtcccttttgggacagagaggtactccttgatctttatgaatgacaggttactgttttgccttattgcttaacttaatgtagtgaaataaagcagacaaagcttggaaaaaaaaaaaaaaaaaaaaaaaacagtgggggcggcctcggccccaaaaggtttccacacacatctcttgggggggccatgtatgaacgcgccaagggtcccagaacgggcccgcatggggtcccccaaaaaccgggcccgtggaac

SEQ ID NO: 298040 - DNA, 4139 bp, Homo sapiens
ggaaacctaacgtcaaagtctacgtaggaagtcgtagggaaggcagcgaggaagacgctggctctcgggtcacgtgatgcgccgggagcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactctaaaagacactaaattgtactaattgtacaaaggtcaagccaattttatgaaacagtcctacagagtaatatatgtgatgcagtgtaagaaggaaaatactcatctctaacattatggtaataacatttagcctcttaggagttggagcagggggatgggtaattacagatttgcagactatagaaagagtttcatttttttgtgaccccacagagtctcaaatttttatttcactacctgctagagcctactgtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgtgaagaaacaccctttttggtcccttttgggacagagaggtactccttgatctttatgaatgacaggttactgttttgccttattgcttaacttaatgtagtgaaataaagcagacaaagcttgagcgtgtcttttgtttgctctcatgtagatactaagtagcatggctcagagccaaaagacaagcgtgaagttaagagagttggctaagagagttggtggggcatgctcccttccattccttaaatgaagtaatctaaaatctcttagcaggttagttcaccataatatataagtagatgttgctttgagcttcttatatacatattcacagaaccattatataaatgttgttagacctctac

SEQ ID NO: 298041 - DNA, 3848 bp, Homo sapiens
ggaaacctaacgtcaaagtctacgtaggaagtcgtagggaaggcagcgaggaagacgctggctctcgggtcacgtgatgcgccgggagcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtagaccaccagctgcaccgtgttttctgtaaaagtattgttagtaagtggccaagagacttgaggaaaatacagattttttgtttaccttggtcttgttttaagtcttaaaaaattaaagataacattataatgtagaatacagatgggacatagtccttgtaagcttcccttgaaaatgttttaaatatttaggaagcttttaaaagacactaaattgtactctaaaagacactaaattgtactaattgtacaaaggtcaagccaattttatgaaacagtcctacagagtaatatatgtgatgcagtgtaagaaggaaaatactcatctctaacattatggtaataacatttagcctcttaggagttggagcagggggatgggtaattacagatttgcagactatagaaagagtttcatttttttgtgaccccacagagtctcaaatttttatttcactacctgctagagcctactgtgaaatcactgctccatatttgccagtggaggaaatgggcatagagtagagaatagcttcatatgtttacacgtttgcatagactacacacatgtcatgcgtttatggcaggtagctggtatttattccccaaagtaataatgttgaagtatgggtctcatcattcccatacacagaaacacaaaacactttgatcataaacttttttcttcagaagccaaactaacttgcagaataatagagccactggtttaatgtttcctcaagataggttttagtgtaagctagtattctgtgtgttcgtagaaatgattcaatacctgcagctggtgaattaggaattgtatttgttgccttttttatattagatgaggtgcaaaaattttaatgctagtcagtatgcaccaccacaggaaagttagatcccattagcacttgaaactacagctttggaaacttaggctaagttaatttggatttgttacttgattcacctactgaccttttcttttgtttgaagtgcttatcagcataatgagctaagtgtcatgcatatttgatctttatgaatgacaggttactgttttgccttattgcttaacttaatgtagtgaaataaagcagacaaagcttg

SEQ ID NO: 298042 - DNA, 2740 bp, Homo sapiens
ggaaacctaacgtcaaagtctacgtaggaagtcgtagggaaggcagcgaggaagacgctggctctcgggtcacgtgatgcgccgggagcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtcaattatattccagaagtgagaatcatgtcaattcccaaccttcgctacatgaaggagagccaggtcctcctgactcttacaaatccagttgagaacctcacccatgtgactctcttcgagtgtgaggagggggaccctgatgatatcaacagcactgctaaggtggtggtgcctcccaaagagctcgttttagctggcaaggatgcagcagcagagtacgatgagttggcagaacctcaagactttcaggacgatcctgacattatagccttcagaaaggccaacaaagtgggtattttcatcaaagttacaccacagcgtgaggagggtgaagtgaccgtgtgcttcaagatgaagcatgattttaaaaacctggcagcccccattcgccccattgaagaaagtgaccagggaacagaagtcatctggctcacccagcatgtggaacttagcttgggcccacttcttccttaaaaggttccactggagggcagatcccaaaggacagtatcaccgtaaacctgcgttaaaatgtggaagctgctgcttcattaggccttgtttataacgatgtacccatgcactacggaattctattgctaagaaagtgggagcataggcaaggcattgggaacacagggtagctgctgttgctcttgctctcacccctgttgacaccagtaagtctgtgtctccctcactgaaccctgcacgttgagtaacagcagcataattccatcctaggaaaggggatgggtgttccttggaatggcattgtatttaccacctgagaaactctgtactgtctcttgatctgatctcactaaggatcacaatgtcacagatgaaacttaaatgataacccaaaggtagacctgctgttaatgatccagcattggtcacaatgtaccaactgctttctgcattccgttaaatatcatctaacagtctaaaacatatcccttcattgccataatggctgccattttgccatagatttccatataactgaaaaactgaattgtcactttatctttagtatcatgatgattggaaaaacctgtgaagttgttaaggcactctcatttgccctctttttctaagtgaatacaggacacgtattagttgttcttaatttttttcccagtaaaatatggatcttttaagaagaatttgagaagcaaacaattacatgtcatgtcaagggggtagcagattccattcgttttcaatattgccacaatacccagggattaatgctgccacaggggggcaatctttatttgtcttacttcctaccccttccctgttctgcctctttaactcagttaagttgttctgtttgggacctggaaaagaacccaaagaaaacctgagtggacaggttcatttctggaatgcagaaaacattttaaaggctagatttttagaatattctcaactagcattctttccattgatttgaaggggaaattaactattataatctcttgaatccaaaactggatattaagaactttcccccttactaagtttaagacttttgtcatgtggtgagtcaaataagaccattttgattgtaaaccataaaatagttcagcaagtagcccacagttctggcctaacagcagacttgctgttttcacttggtatcctggagttgggttgctaaccttaatttctatgatgttttctaaaatgaaacttgataaagtaga

SEQ ID NO: 298043 - DNA, 1340 bp, Homo sapiens
ggaaacctaacgtcaaagtctacgtaggaagtcgtagggaaggcagcgaggaagacgctggctctcgggtcacgtgatgcgccgggagcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcaaacggtccctgcgctgccgtaaatgtgaacataatttgagcaagccagaatttaacccaacgtcaatcaaattcaaaatccagctggtcgctgtgtaagtattttgggattggtgttttcagttactgttttgagttattttggtttattcttcttccccagtatgaagtgtgtttactcttggcctaaaaaaaaaaaaattacatcaaaataatcttgacattctgttcctgtttaggtttttaatttagttacatgccatgaagtttaagataaatagattcaggggtattgggatcagggacacagtgtcccagtatgatctggagcaacaaggtatgttgattatttggtggaaagtcactagtcatcattacaaattataaagtatctgagtttgggaataatccttc

SEQ ID NO: 298044 - DNA, 1057 bp, Homo sapiens
ggaaacctaacgtcaaagtctacgtaggaagtcgtagggaaggcagcgaggaagacgctggctctcgggtcacgtgatgcgccgggagcgtcatcgcctcctccctccccaagatggcgtccttgctgcagtcggaccgggttctctatctagtccagggagaaaagaaggttcgggccccgctctcgcaactctacttctgccgctattgtagcgaactgcggtcgctggaatgtgtgtctcacgaggtggactcccattattgtcccagttgtttagaaaatatgccatcggctgaagccaaactaaaaaagaatagatgtgccaattgttttgactgtcctggctgcatgcacaccctctctactcgggccacgagcatctccacacagcttccagatgacccagccaagaccaccatgaagaaagcctattacctggcatgtggattttgtcgctggacgtctagagatgtgggcatggcagacaaatctgtagctagtggcggttggcaggaacctgaaaatcctcacacacaacggatgaacaaattgattgaatattaccagcagcttgctcagaaagagaaggttgagcgagatcgcaagaaactggcacgacgtagaaactatatgcctctggctttttcggacaaatatggtcttggaaccaggcttcagcgaccacgagctggtgcatccatcagtacccttgccggactttcccttaaagaaggagaggatcagaaagagataaagattgagccagctcaggctgtggatgaagtggaacctctacctgaagactattatacaagaccagtaaatttaacagaggtaacaacccttcagcagcgtctgttacagcctgacttccagccagtctgtgcttcacagctctatcctcgccacaaacatcttctgatcctctccttctttaaggctgaaaaattaaaaaaacaaaacaaaacaaaacaaaagagtaatttctcacggatccacctgatatcctcagtctatatatcaataagttgaagtgggtatcctctagataagcc

SEQ ID NO: 298045 - DNA, 522 bp, Homo sapiens
gagaaatctttaaaaaaatgtccttcaaaacctaaaagtatggtcaagttttatagtcatataaagctagcctagacaggaggatattttatcacaatgttacaaattggattattttattaatctctttattaatcatagaattctatggagttcaactggaaattgtagattgttaaataaacaacttttaacacataaaaccctgatgatggaataggaaagatcagaaaaatagaaggattttttaaatccggaagaagaagaaaaaaaaaaaacaggtgactgaagaagaataaaccctaagcagaaaacagtctactttctgctacagtataacatattttaaaattcactatttgacaagacatatacacaagttaaactgagttctcctctggttttttttttctttcttgtttcctcctaggtggactcccattattgtcccagttgtttagaaaatatgccatcggctgaagccaaactaaaaaagaataggtaagacctggactgattttt

SEQ ID NO: 298046 - DNA, 414 bp, Homo sapiens
catgaaatgactttgaggagaacagcaggtatcaaaatgaatatcaaataaatgagattaaaacacacacacacacacagttgtcaatggaaaagaagattctcatacttagaaaagacctacgctatacagatattctatgacagaggaatacttcaattattgatatcatagactgaggataatcaggtggatccgtgagaaattactcttttgttttgttttgttttgtttttttaatttttcagccttaaagaaggagaggatcagaaagagataaagattgagccagctcaggctgtggatgaagtggaacctctacctgaagactattatacaagaccagtaaatttaacagagggtaattttctgtgtttttctactttgtttctagtctacatctaattctgtttt

SEQ ID NO: 298047 - DNA, 467 bp, Homo sapiens
agttaaaccagtgagcacgttgtttagcaaatacagtatgtactcagtatgtgttattttagtagtttttaagtaccacagaggtataataatattggatagtggggttgcacatatcaggaagtgcgaacatcttttataaactttggctgctatacattattcaaaaacatatggtcttatagcagaacaaaacaaaacaaaattctcgtaaatgctgtccttctgaatttagcagctctatggatcaacaaagtgtgttgttgtcttctgatacgtgttatatttgttttctttttagaaatgtgaacataatttgagcaagccagaatttaacccaacgtcaatcaaattcaaaatccagctggtcgctgtgtaagtattttgggattggtgttttcagttactgttttgagttattttggtttattcttcttccccagtatgaagtgtgtttactcttggcc

SEQ ID NO: 298048 - DNA, 1146 bp, Homo sapiens
tattttgtaggaaaaagcgaaagtgtgaatgaggatacatcgaatcctattttaacttagacagcaagacttggctaagagtcgccaactctgttttgtcctattttgctcagttctttgcatggccttctatttctgtgccccaccatggggttacacccctaaaacacactggcccagcatgatatgtgtgctggcttgccagccaagtggcccgaagctcctcttgagtgcactgcagtacaaccacttgacttgctctttaacatagtcctgtgagatgccagctgccatgaccaagcagtattcccactcctcctctacactctggcaaggctttcctggaacatccccatgcccacatctttacccagtaactcactaaagccactcttgactcaagcaggtgccgttccttgatcacggaatctacctttgatttcatcaggccagattcacaaacagaatgggagtgctttatctatacctttgagaggatggagagtgaaataactggaaacactgggttatcacagcttaatttcatccaggcttggtgtctttaccaaagatggttggggaaaggaagggagattcatcttgttcaggcagtgatttgctcagaattttacaagacataccctatacagacctatttgaattctactgtgggtttattgaaccagtgttggaacaacttcgcaaaacagaccaggccagttaggtacagcctcatgagttggcaggtagcagcagcccgtgtcttccctaagatgacattccctgcccaaaacacttctgtgaaaagtacagaataaacagctcagagaatacagtgtaagttacccgcagaaatatagtacttctttctagaagtttacaaactgtccatgtttatcccttgccatatagcaatcactactattagtgctgtacttaattatttgtttatctgatttctaattgttaatgcttcccccaaatattgtgtgacatttgtaattaataaaaatcacttaacgatgaattagtgagcagttcatgtttgtgtttttgcttaattactgaaagttggttgtaagttctgggggcagggtgcacattttcaagggtagatgatttggggtcttttgtgagtgggaagct

SEQ ID NO: 298049 - DNA, 449 bp, Homo sapiens
tactactactaaattcgcggccgcgtcgtacagcctcatgagttggcaggtagcagcagcccgtgtcttccctaagatgacattccctgcccaaaacacttctgtgaaaagtacagaataaacagctcagagaatacagtgtaagttacccgcagaaatatagtacttctttctagaagtttacaaactgtccatgtttatcccttgccatatagcaatcactactattagtgctgtacttaattatttgtttatctgatttctaattgttaatgcttcccccaaatattgtgtgacatttgtaattaataaaaatcacttaacgatgaattagtgagcagttcatgtttgtgtttttgcttaattactgaaagttggttgtaagttctgggggcagggtgcacattttcaagggtagatgatttggggtcttttgtgagtgggaagct

SEQ ID NO: 298050 - DNA, 293 bp, Homo sapiens
tcgcaacccatccttccttctctcacgcaaactgtccatgtttatcccttgccatatagcaatcactactattagtgctgtacttaattatttgtttatctgatttctaattgttaatgcttcccccaaatattgtgtgacatttgtaattaataaaaatcacttaacgatgaattagtgagcagttcatgtttgtgtttttgcttaattactgaaagttggttgtaagttctgggggcagggtgcacattttcaagggtagatgatttggggtcttttgtgagtgggaagct

SEQ ID NO: 298051 - DNA, 1009 bp, Homo sapiens
  misc_feature (9)..(9): n is a, c, g, or t
ggactggcncgaggcagacgtccctgcgcgtcgtcctcctcgccctccaggccgcccgcgccgcgccggagtccgctgtccgccagctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcggtgcgtacccggtgtcccgaggcccggccaggggctgggcagggatgccaggtgggcccagccagctcctggggtcccggccacctggggaagccgcgcctgccaaggaggccaccagagggcagtgcaggcttctgcctgggccccaggccctgcctgtgttgaaagctctggggactgggccagggaagctcctcctcagctttgagctgtggctgccacccatggggctctccttccgcctctcaagatccccccagcctgacgggccgcttaccatcccctctgccctgcaagccagccgccaaggttgacctcagcttcggagccacctctggatgaactgcccccagcccccgccccattaaagacccggaagcctga

SEQ ID NO: 298052 - DNA, 714 bp, Homo sapiens
  misc_feature (9)..(9): n is a, c, g, or t
ggactggcncgaggcagacgtccctgcgcgtcgtcctcctcgccctccaggccgcccgcgccgcgccggagtccgctgtccgccagctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcgagccagccgccaaggttgacctcagcttcggagccacctctggatgaactgcccccagcccccgccccattaaagacccggaagcctga

SEQ ID NO: 298053 - DNA, 757 bp, Homo sapiens
  misc_feature (9)..(9): n is a, c, g, or t
ggactggcncgaggcagacgtccctgcgcgtcgtcctcctcgccctccaggccgcccgcgccgcgccggagtccgctgtccgccagctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcgagccagccgccaaggttgacctcagcttcggagccacctctggatgaactgcccccagcccccgccccattaaagacccggaagcctgaaacaaaaacaaaaaacaacaacaaaaacaaaaaacaaaggggg

SEQ ID NO: 298054 - DNA, 1816 bp, Homo sapiens
agaaactgatgtttattttccatcaaccatttttccatgctgcttaagagcctatgcaagaacagcttaagaccagtcagtggttgctcctacccattcagtggcctgagcagtgggagctgcagaccagtcttccgtggcaggctgagcgctccagtcttcagtagggaattgctgaataggcacagagggcacctgtacaccttcagaccagtctgcaacctcaggctgagtagcagtgaactcaggagcgggagcagtccattcaccctgaaattcctccttggtcactgccttctcagcagcagcctgctcttctttttcaatctcttcaggatctctgtagaagtacagatcaggcatgacctcccatgggtgttcacgggaaatggtgccacgcatgcgcagaacttcccgagccagcatccaccacatcaaacccactgagtgagctcccttgttgttgcatgggatggcaatgtccacatagcgcagaggagaatctgtgttacacagcgcaatggtaggtaggttaacataagatgcctccgtgagaggctggtggtcagccctggggtcagtaaccacaagaagccgtggctcccggaaggctgcctggatctggttagtgaaggttccaggagtgaagcggccagcaattggagtggctccagtggcagcagcaaacttcagcacagccctctggccagtattcctggaggatataacactgacatcagcagggttttcaatggcaacaattgcacgagctgccagcagaagcttctcccaggtcctcttgagatttatgatatagatgccatcacttttccttttatagatgtactgttccatctggaagtcaagattggtgccacctaagtgggttcctgctgcaaggaacttaaggacatcctcctccttcatttgcaggacatcaagggctccggacattgtgaaaatttccctttaagttacgacgggaatccagaacaacgccgtatggacggctgccgcctctggccccaaccagatgtccttcaccttcgcctctcccacgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcggtgcgtacccggtgtcccgaggcccggccaggggctgggcagggatgccaggtgggcccagccagctcctggggtcccggccacctggggaagccgcgcctgccaaggaggccaccagagggcagtgcaggcttctgcctgggccccaggccctgcctgtgttgaaagctctggggactgggccagggaagctcctcctcagctttgagctgtggctgccacccatggggctctccttccgcctctcaagatccccccagcctgacgggccgcttaccatcccctctgccctgcaagccagccgccaaggttgacctcagcttcggagccacctctggatgaactgcccccagcccccgccccattaaagacccggaagcctga

SEQ ID NO: 298055 - DNA, 642 bp, Homo sapiens
  misc_feature (19)..(19): n is a, c, g, or t
  misc_feature (30)..(30): n is a, c, g, or t
ccgggttaaatgcgagggntctccttccgnctctcagatccccccacgtgcccacgctgcaggtcctgcggccggggctggtcgtggtgcatgcagaggacggcaccacctccaaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcggtgcgtacccggtgtcccgaggcccggccaggggctgggcagggatgccaggtgggcccagccagctcctggggtcccggccacctggggaagccgcgcctgccaaggaggccaccagagggcagtgcaggcttctgcctgggccccaggccctgcctgtgttgaaagctctggggactgggccagggaagctcctcctcagctttgagctgtggagccagccgccaaggttgacctcagcttcggagccacctctggatgaactgcccccagcccccgccccattaaagacccggaagcctga

SEQ ID NO: 298056 - DNA, 1029 bp, Homo sapiens
ggacgcgtgggcggacgcgatgggtcgacccacgcgtcgcggacgcgtaggggtcctcctcgccctccaggccgcccgcgccgcgccggagtccgctgtccgccagctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcggtgcgtacccggtgtcccgaggcccggccaggggctgggcagggatgccaggtgggcccagccagctcctggggtcccggccacctggggaagccgcgcctgccaaggaggccaccagagggcagtgcaggcttctgcctgggccccaggccctgcctgtgttgaaagctctggggactgggccagggaagctcctcctcagctttgagctgtggctgccacccatggggctctccttccgcctctcaagatccccccagcctgacgggccgcttaccatcccctctgccctgcaagccagccgccaaggttgacctcagcttcggagccacctctggatgaactgcccccagcccccgccccattaaagacccggaagcctga

SEQ ID NO: 298057 - DNA, 1516 bp, Homo sapiens
  misc_feature (9)..(9): n is a, c, g, or t
ggactggcncgaggcagacgtccctgcgcgtcgtcctcctcgccctccaggccgcccgcgccgcgccggagtccgctgtccgccagctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcggtgcgtacccggtgtcccgaggcccggccaggggctgggcagggatgccaggtgggcccagccagctcctggggtcccggccacctggggaagccgcgcctgccaaggaggccaccagagggcagtgcaggcttctgcctgggccccaggccctgcctgtgttgaaagctctggggactgggccagggaagctcctcctcagctttgagctgtggctgccacccatggggctctccttccgcctctcaagatccccccagcctgacgggccgcttaccatcccctctgccctgcaagccagccgccaaggttgacctcagcttcggagccacctctggatgaactgcccccagcccccgccccattaaagacccggaagcctgaaaaaaaaaaaaaaaaaaaaaaacaaccacacacaaacaaacaccacaatacagccacacctcaaaaagaaacatacaagaaatacaacatcaacacaacaaacaatataagccggaaacagatacagacatctgttccacagccgcgcgcgctcagagggaaagacgaggacacggagaggagaggacacgagcggggcggggaggaacagctgtgcagcgcggcagcacacgctaagaaaagacagggccagcgcgcgccaaacaagagcgacgagaagacgcggagggagcagcggaagcaacgcggaaggtgaggaacggacaccgagacgaggcggagcaggagaagggcgagaagaagggggcgtagcgacgaggcggagacacaaccgggagcgaggagtgacgaggagggagcgagagggcgcggtcaggaggcgcggggacgcggaggcaaggacccgcagagacgacctcgccccactcccgaggaggagagcgggga

SEQ ID NO: 298058 - DNA, 779 bp, Homo sapiens
  misc_feature (9)..(9): n is a, c, g, or t
ggactggcncgaggcagacgtccctgcgcgtcgtcctcctcgccctccaggccgcccgcgccgcgccggagtccgctgtccgccagctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcgagccagccgccaaggttgacctcagcttcggagccacctctggatgaactgcccccagcccccgccccattaaagacccggaagcctgaaaaaaaaaaaaaaaaaaaaaaaaacaaaaacaaaaaacaacaacaaaaacaaaaaacaaaggggg

SEQ ID NO: 298059 - DNA, 933 bp, Homo sapiens
  misc_feature (9)..(9): n is a, c, g, or t
ggactggcncgaggcagacgtccctgcgcgtcgtcctcctcgccctccaggccgcccgcgccgcgccggagtccgctgtccgccagctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcgagccagccgccaaggttgacctcagcttcggagccacctctggatgaactgcccccagcccccgccccattaaagacccggaagcctgagtgataacaatacgaacaaaaaaggaaaaaaaggaaatatcaaacgtcaatatcacgggggggaccgggaaccaaatctccctatagtgagtcgcaataccattacagtacccctggtgagaccgttctcagtgtgcccactttggattcgcaaccattcaggtgcctggatttagccttgggcgtggtactgggatatcgcgtaccgcgcgagccgct

SEQ ID NO: 298060 - DNA, 953 bp, Homo sapiens
  misc_feature (9)..(9): n is a, c, g, or t
ggactggcncgaggcagacgtccctgcgcgtcgtcctcctcgccctccaggccgcccgcgccgcgccggagtccgctgtccgccagctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggtgttcttcaacggtgccaacgtccggcaggtggacgtgcccacgctgaccggagccttcggcatcctggcggcccacgtgcccacgctgcaggtcctgcggccggggctggtcgtggtgcatgcagaggacggcaccacctccaaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcggtgcgtacccggtgtcccgaggcccggccaggggctgggcagggatgccaggaggccaccagagggcagtgcaggcttctgcctgggccccaggccctgcctgtgttgaaagctctggggactgggccagggaagctcctcctcagctttgagctgtggctgccacccatggggctctccttccgcctctcaagatccccccagcctgacgggccgcttaccatcccctctgccctgcaagccagccgccaaggttgacctcagcttcggagccacctctggatgaactgcccccagcccccgccccattaaagacccggaagcctga

SEQ ID NO: 298061 - DNA, 1146 bp, Homo sapiens
ctttggggtctcacgccttccccccgccccattcccccagtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggccctggtgaaggccctggagtaggcggtgcgtacccggtgtcccgaggcccggccaggggctgggcagggatgccaggtgggcccagccagctcctggggtcccggccacctggggaagccgcgcctgccaaggaggccaccagagggcagtgcaggcttctgcctgggccccaggccctgcctgtgttgaaagctctggggactgggccagggaagctcctcctcagctttgagctgtggctgccacccatggggctctccttccgcctctcaagatccccccagcctgacgggccgcttaccatcccctctgccctgcaagccagccgccaaggttgacctcagcttcggagccacctctggatgaactgcccccagcccccgccccattaaagacccggaagcctgaaaaaaaaaaaaaaaaaaaaaaacaaccacacacaaacaaacaccacaatacagccacacctcaaaaagaaacatacaagaaatacaacatcaacacaacaaacaatataagccggaaacagatacagacatctgttccacagccgcgcgcgctcagagggaaagacgaggacacggagaggagaggacacgagcggggcggggaggaacagctgtgcagcgcggcagcacacgctaagaaaagacagggccagcgcgcgccaaacaagagcgacgagaagacgcggagggagcagcggaagcaacgcggaaggtgaggaacggacaccgagacgaggcggagcaggagaagggcgagaagaagggggcgtagcgacgaggcggagacacaaccgggagcgaggagtgacgaggagggagcgagagggcgcggtcaggaggcgcggggacgcggaggcaaggacccgcagagacgacctcgccccactcccgaggaggagagcgggga

SEQ ID NO: 298062 - DNA, 1267 bp, Homo sapiens
  misc_feature (9)..(9): n is a, c, g, or t
ggactggcncgaggcagacgtccctgcgcgtcgtcctcctcgccctccaggccgcccgcgccgcgccggagtccgctgtccgccagctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggtgttcttcaacggtgccaacgtccggcaggtggacgtgcccacgctgaccggagccttcggcatcctggcggcccacgtgcccacgctgcaggccctggtgaaggccctggagtaggcggtgcgtacccggtgtcccgaggcccggccaggggctgggcagggatgccaggtgggcccagccagctcctggggtcccggccacctggggaagccgcgcctgccaaggaggccaccagagggcagtgcaggcttctgcctgggccccaggccctgcctgtgttgaaagctctggggactgggccagggaagctcctcctcagctttgagctgtggctgccacccatggggctctccttccgcctctcaagatccccccagcctgacgggccgcttaccatcccctctgccctgcaagccagccgccaaggttgacctcagcttcggagccacctctggatgaactgcccccagcccccgccccattaaagacccggaagcctgaaaaaaaaaaaaaaaaaaaaaaacaaccacacacaaacaaacaccacaatacagccacacctcaaaaagaaacatacaagaaatacaacatcaacacaacaaacaatataagccggaaacagatacagacatctgttccacagccgcgcgcgctcagagggaaagacgaggacacggagaggagaggacacgagcggggcggggaggaacagctgtgcagcgcggcagcacacgctaagaaaagacagggccagcgcgcgccaaacaagagcgacgagaagacgcggagggagcagcggaagcaacgcggaaggtgaggaacggacaccgagacgaggcggagcaggagaagggcgagaagaagggggcgtagcgacgaggcggagacacaaccgggagcgaggagtgacgaggagggagcgagagggcgcggtcaggaggcgcggggacgcggaggcaaggacccgcagagacgacctcgccccactcccgaggaggagagcgggga

SEQ ID NO: 298063 - DNA, 465 bp, Homo sapiens
  misc_feature (9)..(9): n is a, c, g, or t
ggactggcncgaggcagacgtccctgcgcgtcgtcctcctcgccctccaggccgcccgcgccgcgccggagtccgctgtccgccagctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggtgttcttcaacggtgccaacgtccggcaggtggacgtgcccacgctgaccggagccttcggcatcctggcggcccacgtgcccacgctgcaggccctggtgaaggccctggagtaggcgagccagccgccaaggttgacctcagcttcggagccacctctggatgaactgcccccagcccccgccccattaaagacccggaagcctga

SEQ ID NO: 298064 - DNA, 728 bp, Homo sapiens
cctcctcgccctccaggccgcccgcgccgcgccggagtccgctgtccgccagctacccgcttcctgccgcccgccgctgccatgctgcccgccgcgctgctccgccgcccgggacttggccgcctcgtccgccacgcccgtgcctatgccgaggccgccgccgccccggctgccgcctctggccccaaccagatgtccttcaccttcgcctctcccacgcaggttcgggcgctgcgggtcgggaccctccgtggccgccgcccccggagtccagggtccccacccccagggcgcgacccccgcttccgggcccccggacccgcgcgccccggaagccgaggctactcagccctggaccctcggccctgcctctgctgcccgagccctgcgctgccctcgtcccgggcacctccccgagataagcgtctcctgggtgccctccccgatctccctggccaaagcctgggtgtcgccggatcgttgcattcccatttcgcggatcagtagaatgaggcgcaactgttgaggaccaaagctgcaacttcggatccctgcgctgggttgtctcagtgcctcacatcagcgccaggtcctgccctgacccattacttagcaggacaggccgagtgcccggtgggcgcggggccggcctgccccgccatcattccccacgctgttgtctgcaggtgttcttcaacggtgccaacgtccggcaggtggacgtgccc

SEQ ID NO: 298065 - DNA, 2124 bp, Homo sapiens
  misc_feature (1697)..(1697): n is a, c, g, or t
cgcgtcacctgacgcacttgacagcccgctgaggacgcagcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaaaaaaaaaaaaaaaaaanaaaaaaaaaataaacaaaaaaaagggggggggcgcgcataaaaatatatccccgcgggggggccaccattttgagggtgtacacccggtttttttgtgtaccaaggggccccccatagggggggcggctattaaaaaaccagaggcgcgggggccgattgtttaaaaaaaggttgtctgaagggggagaaaaaagtggtagtagcgggggacattttttgtggagagggaacccctaatttttggggtggcggtgggcacatattggtggacacattaccatgaagaagaaatttaacggtcctcggggggaaacatcaaacatttcgcagggtgtttaagcgtgtgttcaaaccaccggggaaattgtcgttgggtgtgtagaaaatttggtctacggcggagtattgattcggaaaatttttagc

SEQ ID NO: 298066 - DNA, 1703 bp, Homo sapiens
  misc_feature (1648)..(1648): n is a, c, g, or t
  misc_feature (1681)..(1681): n is a, c, g, or t
cgcgtcacctgacgcacttgacagcccgctgaggacgcagcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttgggtgtgtgtgtgtatgttcgtgtacacttggctgtcaggctttctgtgcntgtactaaaaaaggagaaattataataaattancgtctttggcgccctaggccta

SEQ ID NO: 298067 - DNA, 1380 bp, Homo sapiens
  misc_feature (1367)..(1367): n is a, c, g, or t
cgcgtcacctgacgcacttgacagcccgctgaggacgcagcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagctcagtcgaacggactgggagatcactcnagagcactacaca

SEQ ID NO: 298068 - DNA, 2089 bp, Homo sapiens
  misc_feature (1662)..(1662): n is a, c, g, or t
cgcgtcacctgacgcacttgacagcccgctgaggacgcagcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaagtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaaaaaaaaaaaaaaaaaanaaaaaaaaaataaacaaaaaaaagggggggggcgcgcataaaaatatatccccgcgggggggccaccattttgagggtgtacacccggtttttttgtgtaccaaggggccccccatagggggggcggctattaaaaaaccagaggcgcgggggccgattgtttaaaaaaaggttgtctgaagggggagaaaaaagtggtagtagcgggggacattttttgtggagagggaacccctaatttttggggtggcggtgggcacatattggtggacacattaccatgaagaagaaatttaacggtcctcggggggaaacatcaaacatttcgcagggtgtttaagcgtgtgttcaaaccaccggggaaattgtcgttgggtgtgtagaaaatttggtctacggcggagtattgattcggaaaatttttagc

SEQ ID NO: 298069 - DNA, 1977 bp, Homo sapiens
cgcgtcacctgacgcacttgacagcccgctgaggacgcagcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtgagtctgcagggtctgcttgtcagagggaggccaacctggtggtttagacctgactctgtggccatggccacctggacaccacatctgcccgtgtccacaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaaaaagggcccaaaaaacagacaaaaacaaaaccccgagggagcccctacacagacacgaggttgcggaccaacgagaggaaaaagacaggggccccaggtgccccagggggaacacgggacccgaccaccgctggtcacggggtggaaagattggagactcccaaagagaggggaaaatgaaaacgccgggaacg

SEQ ID NO: 298070 - DNA, 2077 bp, Homo sapiens
cgcgtcacctgacgcacttgacagcccgctgaggacgcagcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggtgagtgccccggctggcaggacagcggttggatgtgttgtcaccaagcacccccacccagaaccctcatgcttgtgcttccccccacccccctggccaggagtacaagctgctcttcgagggtgcaggtagcaaccctggagacaagacgctggaggaccgattctttgagcacgaggtgagtctgcagggtctgcttgtcagagggaggccaacctggtggtttagacctgactctgtggccatggccacctggacaccacatctgcccgtgtccacaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaaaaagggcccaaaaaacagacaaaaacaaaaccccgagggagcccctacacagacacgaggttgcggaccaacgagaggaaaaagacaggggccccaggtgccccagggggaacacgggacccgaccaccgctggtcacggggtggaaagattggagactcccaaagagaggggaaaatgaaaacgccgggaacg

SEQ ID NO: 298071 - DNA, 1846 bp, Homo sapiens
ccctggagcacttgctggagcagagatcacaggaaggtcactctggccagcaagtagcactgttagaccagtcaagggctgaggtaatgctagggctgagggcacggggcctcacaggctgtgggggagaggcagaactccagcttcagggctacatggactgctgggtgaaggtgacagcgaaccattcaatttggaggacttcattctggtgatgacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaaaaagggcccaaaaaacagacaaaaacaaaaccccgagggagcccctacacagacacgaggttgcggaccaacgagaggaaaaagacaggggccccaggtgccccagggggaacacgggacccgaccaccgctggtcacggggtggaaagattggagactcccaaagagaggggaaaatgaaaacgccgggaacg

SEQ ID NO: 298072 - DNA, 1689 bp, Homo sapiens
  misc_feature (26)..(26): n is a, c, g, or t
ggacgcgtgggtcgacccacgcgtcngcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaaaaagggcccaaaaaacagacaaaaacaaaaccccgagggagcccctacacagacacgaggttgcggaccaacgagaggaaaaagacaggggccccaggtgccccagggggaacacgggacccgaccaccgctggtcacggggtggaaagattggagactcccaaagagaggggaaaatgaaaacgccgggaacg

SEQ ID NO: 298073 - DNA, 1822 bp, Homo sapiens
cgcgtcacctgacgcacttgacagcccgctgaggacgcagcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaaaaagggcccaaaaaacagacaaaaacaaaaccccgagggagcccctacacagacacgaggttgcggaccaacgagaggaaaaagacaggggccccaggtgccccagggggaacacgggacccgaccaccgctggtcacggggtggaaagattggagactcccaaagagaggggaaaatgaaaacgccgggaacg

SEQ ID NO: 298074 - DNA, 1510 bp, Homo sapiens
  misc_feature (26)..(26): n is a, c, g, or t
ggacgcgtgggtcgacccacgcgtcngcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaaaaagggcccaaaaaacagacaaaaacaaaaccccgagggagcccctacacagacacgaggttgcggaccaacgagaggaaaaagacaggggccccaggtgccccagggggaacacgggacccgaccaccgctggtcacggggtggaaagattggagactcccaaagagaggggaaaatgaaaacgccgggaacg

SEQ ID NO: 298075 - DNA, 1225 bp, Homo sapiens
  misc_feature (26)..(26): n is a, c, g, or t
ggacgcgtgggtcgacccacgcgtcnggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaaaaagggcccaaaaaacagacaaaaacaaaaccccgagggagcccctacacagacacgaggttgcggaccaacgagaggaaaaagacaggggccccaggtgccccagggggaacacgggacccgaccaccgctggtcacggggtggaaagattggagactcccaaagagaggggaaaatgaaaacgccgggaacg

SEQ ID NO: 298076 - DNA, 1148 bp, Homo sapiens
cttgcatgtaccggggtgctcgcttcggcagcacatatactaaaattggaacgatacagagaagattagcatagcccctgcgcaaggatgacacgcaaattcgtgaagcgttccatattgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaaaaagggcccaaaaaacagacaaaaacaaaaccccgagggagcccctacacagacacgaggttgcggaccaacgagaggaaaaagacaggggccccaggtgccccagggggaacacgggacccgaccaccgctggtcacggggtggaaagattggagactcccaaagagaggggaaaatgaaaacgccgggaacg

SEQ ID NO: 298077 - DNA, 991 bp, Homo sapiens
cgcgtcacctgacgcacttgacagcccgctgaggacgcagcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgctgtactccgggtagtaatcggccacgttcttgacctgttcatagtcgtcagcccgagccagctgcgccaggccctcagggtagagccgcccacagtttggtccctcggcgtgtgca

SEQ ID NO: 298078 - DNA, 1756 bp, Homo sapiens
gacctcgtgatccacctgccttggcctcccaaagtgctgggattacaggcgtgagccactgcgtccagccacacctggttttcagaggctgaggaaggggaggtttggaaagatttggggaaaaggaaggcagagcagcaggggaaagtcagaggacccctgcgagcccagccttctgtgaggtgagggggtgaaggagactgtagcctgaagcagacagtcgggtgggccctgccctggcactcctgggtgggaggctgtgggcagctgccacttggctgattcacagaagtgtttcattggctttgctgtaagggctgccccggcccatccatgggtgtgcttgtacccaccttgaaaggggctagggaggggaggagggagctgtgagggcttgtgcctagcaagccctccagagcttccttgcctgtgctgagcaagctccatactctctacaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggtgagtgccccggctggcaggacagcggttggatgtgttgtcaccaagcacccccacccagaaccctcatgcttgtgcttccccccacccccctggccaggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaaaaagggcccaaaaaacagacaaaaacaaaaccccgagggagcccctacacagacacgaggttgcggaccaacgagaggaaaaagacaggggccccaggtgccccagggggaacacgggacccgaccaccgctggtcacggggtggaaagattggagactcccaaagagaggggaaaatgaaaacgccgggaacg

SEQ ID NO: 298079 - DNA, 1035 bp, Homo sapiens
cagcatacctgagggtgctgagagtctcctcgttattgatgtcagcagggctcagggccgcaatcatggctgtgcgtgagttcccccccaaatgttccttgagcagccaggtgagcacagagtccctgtgctcagtcgaacggactgcactccgttcgactgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaaaaagggcccaaaaaacagacaaaaacaaaaccccgagggagcccctacacagacacgaggttgcggaccaacgagaggaaaaagacaggggccccaggtgccccagggggaacacgggacccgaccaccgctggtcacggggtggaaagattggagactcccaaagagaggggaaaatgaaaacgccgggaacg

SEQ ID NO: 298080 - DNA, 438 bp, Homo sapiens
cgcgtcacctgacgcacttgacagcccgctgaggacgcagcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacgtgagtgtgctttgtagcgcc

SEQ ID NO: 298081 - DNA, 1874 bp, Homo sapiens
cgcgtcacctgacgcacttgacagcccgctgaggacgcagcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaaaaagggcccaaaaaacagacaaaaacaaaaccccgagggagcccctacacagacacgaggttgcggaccaacgagaggaaaaagacaggggccccaggtgccccagggggaacacgggacccgaccaccgctggtcacggggtggaaagattggagactcccaaagagaggggaaaatgaaaacgccgggaacg

SEQ ID NO: 298082 - DNA, 1861 bp, Homo sapiens
  misc_feature (26)..(26): n is a, c, g, or t
ggacgcgtgggtcgacccacgcgtcngcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcactgattatggtaacttcctggccaacgaggcatcacctctgacggtgtcagtcatcgatgaccggctcaaggagaagatggtggtggagttccgccacatgaggaaccatgcctatgagccactcgccagcttcctagacttcattacttacagttacatgatcgacaacgtgatcctgctcatcacaggcacgctgcaccagcgctccatcgctgagctcgtgcccaagtgccacccactaggcagcttcgagcagatggaggccgtgaacattgctcagacacctgctgagctctacaatgccattctggtggacacgcctcttgcggcttttttccaggactgcatttcagagcaggaccttgacgagatgaacatcgagatcatccgcaacaccctctacaaggcctacctggagtccttctacaagttctgcaccctactgggcgggactacggctgatgccatgtgccccatcctggagtttgaagcagaccgccgcgccttcatcatcaccatcaattctttcggcacagagctgtccaaagaggaccgtgccaagctctttccacactgtgggcggctctaccctgagggcctggcgcagctggctcgggctgacgactatgaacaggtcaagaacgtggccgattactacccggagtacaagctgctcttcgagggtgcaggtagcaaccctggagacaagacgctggaggaccgattctttgagcacgaggtaaagctgaacaagttggccttcctgaaccagttccactttggtgtcttctatgccttcgtgaagctcaaggagcaggagtgtcgcaacatcgtgtggatcgctgaatgtatcgcccagcgccaccgcgccaaaatcgacaactacatccctatcttctagcgtcctggcccaaggctctcaattgcactctttgtgtgtgtgtgtgtgtgtgtgcgcgtgtgtgtgcgtgtgtgtgtatgtggtctgtgacaagcctgtggctcacctgcctgtccggggtgtagtacgctgtcctagcggctgcccagttctcctgaccctcttagagactgttcttaggcctgaaaaggggctgggcacccccccccaccaaggatggacgaagaccccctccagagcaaggaggccccctcagccctgtggttacagccgctgatgtatctaagaagcatgtcactttcatgttcctccctaactccctgacctgagaaccctggggcctgggggcagtttgagcctcctctcccttctgtgggtcgctcccagagccatggcccatgggaaggacagagtgtgtgtgtccttggggcctggggggatgttgctcctcagctccctccctcagccctgcccctctgagacaataaaactgccctctctaaggccaaaaagggcccaaaaaacagacaaaaacaaaaccccgagggagcccctacacagacacgaggttgcggaccaacgagaggaaaaagacaggggccccaggtgccccagggggaacacgggacccgaccaccgctggtcacggggtggaaagattggagactcccaaagagaggggaaaatgaaaacgccgggaacg

SEQ ID NO: 298083 - DNA, 1499 bp, Homo sapiens
gcccggcaaacattccggagcctcggcccgagccgctaacgcaggagcttgggggtacagggacttcagaggcggccaaaaaaaggggtggtggaccactccccagctggtcgccaccatgccagtctctccggcaggcagtcacaagcagcagaacttcgggttgaacaatgccacacaaccaaagaagtctattagcttttttgctacaatgaaagcaacttcagtgaaaggatatactggtgcaaatcaaagcagaatggctgtgtccaaaaccgtgcttattccacctgaactgaaaactgtagaaaaaccaaatcccaatataaagacaacacaggtatttgacataaatggaactgatgttactccccgacctctttaccatccagatccacttactggtacagcaaaaccaagtaaactcttgacatcacaagaaggatcacttggatcagaatttatatcttcctatagcctttatcagaatacaataaatcctagtacgttagggcagtttacaaggtcagttttaggaagcagtacagtttctaagtcaagtgtatcagcaagtgaatcaatagcagaagacctggaagaaccatcctataaacgggaaagattgactagtttcacagatttgcaagttataagggcagcacctgaaaaaattgtaacaaaagaagacctggagaagaatatagagataatactcacagagacagaaacactgagattttttgacttgcccacagtcatggtctctgtagaatctgaagaagctgagaaagtaactcagagaaacaagaattatgaagtcctttgtagaaacagattaggcaatgacctatatgttgaaaggatgatgcagactttcaatggagcaccaaagaataaagatgttcaatgtgataaaatcataatggaagataaaggtaatttctatcattctgcttgataaactataatgttctaatatacattttttgagtctgtcaatcgacaagtgaatattgaaatgtataaagcaaaaataaaaataatttggccaaccacaacagtagttggacactgtgttctatagctttcagaatttgacatgttaagtaataaatatatagatttgaataacataattattcatcttggtttttatgcatactatatcatagaactttatactctttaaacgtttatataaactgattatttactatgtcacaaagaatatcagccataactattaacattttaaatgtgtcagacactatgtccttcacatgtattaactggtttaatttttacagcaaccctatgaggtagatactattatgcttccccattttatagatgaggaaacaggcaaagagaagtttgctaactgttctggttctagagcttgtgcacttaactactatacttaccacctctcactgtgtacaaattaacaaccctgagcacattgcatagccaaaatctgtagggtgtagccaaagaag

SEQ ID NO: 298084 - DNA, 619 bp, Homo sapiens
agggaaaagagaaaaaaataagataggagacctggaattatggatggagaagagtccctgagacaccagtgacaagtttcagagttcacataaaaggaacaatgccacacaaccaaagaagtctattagcttttttgctacaatgaaagcaacttcagtgaaaggatatactggtgcaaatcaaagcagaatggctgtgtccaaaaccgtgcttattccacctgaactgaaaactgtagaaaaaccaaatcccaatataaagacaacacaggtaatattcttagaattctgagtttatttgaaaatggcactgtgaaaaactcaattgaaatgttaaagatagaaaatatgctgctttcagataatcactcataattttgaaatactgattttgttaatttttaccacatattattccatacaacataatattgacacttggctcctataactagttattgataagaagaatattagagtggaatgagaaaagtctattcatgaccttaagaactatttgcttatggtattaattatatacattacaactatctttcactgttgtcagcaatatagtcttgaaaatacaataaaattatttgtcataaagtcagttatt

SEQ ID NO: 298085 - DNA, 3692 bp, Homo sapiens
gcccggcaaacattccggagcctcggcccgagccgctaacgcaggagcttgggggtacagggacttcagaggcggccaaaaaaaggggtggtggaccactccccagctggtcgccaccatgccagtctctccggcaggcagtcacaagcagcagaacttcgggttgaacaatgccacacaaccaaagaagtctattagcttttttgctacaatgaaagcaacttcagtgaaaggatatactggtgcaaatcaaagcagaatggctgtgtccaaaaccgtgcttattccacctgaactgaaaactgtagaaaaaccaaatcccaatataaagacaacacaggtatttgacataaatggaactgatgttactccccgacctctttaccatccagatccacttactggtacagcaaaaccaagtaaactcttgacatcacaagaaggatcacttggatcagaatttatatcttcctatagcctttatcagaatacaataaatcctagtacgttagggcagtttacaaggtcagttttaggaagcagtacagtttctaagtcaagtgtatcagcaagtgaatcaatagcagaagacctggaagaaccatcctataaacgggaaagattgactagtttcacagatttgcaagttataagggcagcacctgaaaaaattgtaacaaaagaagacctggagaagaatatagagataatactcacagagacagaaacactgagattttttgacttgcccacagtcatggtctctgtagaatctgaagaagctgagaaagtaactcagagaaacaagaattatgaagtcctttgtagaaacagattaggcaatgacctatatgttgaaaggatgatgcagactttcaatggagcaccaaagaataaagatgttcaatgtgataaaatcataatggaagataaaggcataatgtccactgcctgggatttgtatgattcttacaatgctatggaacttgtatctttatcagtaaaacaatctgtggttgagtcaagtagtaaagcaaatgtacttcctaaagatcaggaccaaagattgccagggagcactacagaaaaaaatagtgaaactagttctctaatggacatagaaaatgtaattctggcaaaaatccatgaagatgaggaagaccactcagatgcaatattaaaatctgacaaatttcatcaggacttattttttatggaacgggttctgatggaaaatatatttcagcccaaacttgcagcttatcgtcagcttcctgttttaaaagaacctgaacctgaagagcctgaagatgttttagaaagtgcaaaacatgaagaggtagaggaagaatctaagaaggaggaggaagaagaaatacatgcagaagaatcaacaatacccgccaacttggaacgactttggtctttttcctgtgacttaaccaaaggcctcaatgtgagcagccttgcctggaataaaacaaatccagatcttttggctgttggctatgggcactttggatttaaagagcaaaaaagaggactggcttgctgctggtcaataaagaatcccatgtggccagaacgtatttatcagagtccatatggagttactgctgtggatttttcaattggagcacctaaccttttagccgttggctatcacaatggcacaattgcaatttacaatgtacggagcaacagtaatgttccagttctggatagtagtgaatcacctcaaaaacatttgggacctgtatggcaactacagtggatagaacaagatcgaggaacaacaggagatggcaaaagagaaatactagtttctatatcagcagatggaagaatctccaaatgggttatacgaaaaggactagactgttatgatttgatgcgattaaagagaactacagctgccagtaacaaaaaaggaggggaaaaggaaaagaaagatgaagctttgatatctcgacaggctcctggaatgtgttttgcttttcatcccaagggtccagtgtataaagtgacatggaatccattttgtcatgatgtatttttaagctgttctgcagattggggtgttattatatggcaacaggagaatgtcaagccatctttgagtttttatccagctacttctgttgtttacgacgttgcctggtctccaaaatcatcctatatatttgcagctgcaaatgagaacagggtggagatttgggaccttcatatcagcactttggaccctctgattgtgaatactgctaaccctggaatcaagttcacaaccattctctttgccaaacaaacagattgccttctggtaggagacagtgatggacaggtttctgtgtatgaactgagaaatatgcctactgttttggaaactggccggggagatataatggatactttgcttggatccaagtcaaaccaatcagcataattcatcattcctaatatttttcttgtagttgttttaaaaaaggaattaacatccaatattctgtattacatactgtacaccagattttgatttcagaaaacaatatttgatgtataacttccacttaatttaaatttaataaacttttatttcagagatatttgattagtttacaatctaagagttattcttaagagtttcagtggaattttcttaatttttctaaagatattcctactctcttgatcatattctaagtacatatgagtacatgtacattcttatacaatgtctaaatgggttagaaaattattatacctatagaagcgaaacttggaaattaatagaatcacttaaaccaaaatctttataagacacaattctattgattttaaagcttctgctttccaggctctgttttccagagtttataattacgtagtttttagtagatgaaaataatggattcttgtacctaacattttatcctcttagatctaagagccgaagctatagaactttgttagactatttggcaagcaaaatatatgacagtaaatatcagaattttatggtttgaccagcgcttatcacattcccaattcagtgagaaaaattcatctgggacacaacagggtactcttctctgtttgcccagaatcagctctggattttaagcccagacttcagtggacccagatagaaaatataaagtctctgatctataggccacatcaggatgttattttatgaagagttctagagcaaggttgcggaaatcggggtggagatggggagcagtgactcctccaaatattcattgctaacaggccattctatgcagtttgttttaacaaatcctgggttaaactgaggccacaggacatgatgggctgttctataaagcattctaagtggagaggagacgatagggcatatgaaattcactaaactctctggaaaaaaaatatgtatatattaaaaaccaagactggaatcagtgcaacagtgggaactaccttttacaagtatccattgcttcataaactccatttgtttggaccaatcccttaaacaaaagcaaggcaaattttacatggatttagagcctaggtcaggttattaggattataaattttccactggtatgtcattgtgattatctttgtttttgtctttctgaaagattggattttctataacaccttgtgtaagaaaataaaaaacttgatctaactgaaaaatgtgt

SEQ ID NO: 298086 - DNA, 3588 bp, Homo sapiens
gcccggcaaacattccggagcctcggcccgagccgctaacgcaggagcttgggggtacagggacttcagaggcggccaaaaaaaggggtggtggaccactccccagctggtcgccaccatgccagtctctccggcaggcagtcacaagcagcagaacttcgggttgaacaatgccacacaaccaaagaagtctattagcttttttgctacaatgaaagcaacttcagtgaaaggatatactggtgcaaatcaaagcagaatggctgtgtccaaaaccgtgcttattccacctgaactgaaaactgtagaaaaaccaaatcccaatataaagacaacacaggtatttgacataaatggaactgatgttactccccgacctctttaccatccagatccacttactggtacagcaaaaccaagtaaactcttgacatcacaagaaggatcacttggatcagaatttatatcttcctatagcctttatcagaatacaataaatcctagtacgttagggcagtttacaaggtcagttttaggaagcagtacagtttctaagtcaagtgtatcagcaagtgaatcaatagcagaagacctggaagaaccatcctataaacgggaaagattgactagtttcacagatttgcaagttataagggcagcacctgaaaaaattgtaacaaaagaagacctggagaagaatatagagataatactcacagagacagaaacactgagattttttgacttgcccacagtcatggtctctgtagaatctgaagaagctgagaaagtaactcagagaaacaagaattatgaagtcctttgtagaaacagattaggcaatgacctatatgttgaaaggatgatgcagactttcaatggagcaccaaagaataaagatgttcaatgtgataaaatcataatggaagataaaggcataatgtccactgcctgggatttgtatgattcttacaatgctatggaacttgtatctttatcagtaaaacaatctgtggttgagtcaagtagtaaagcaaatgtacttcctaaagatcaggaccaaagattgccagggagcactacagaaaaaaaacctgaacctgaagagcctgaagatgttttagaaagtgcaaaacatgaagaggtagaggaagaatctaagaaggaggaggaagaagaaatacatgcagaagaatcaacaatacccgccaacttggaacgactttggtctttttcctgtgacttaaccaaaggcctcaatgtgagcagccttgcctggaataaaacaaatccagatcttttggctgttggctatgggcactttggatttaaagagcaaaaaagaggactggcttgctgctggtcaataaagaatcccatgtggccagaacgtatttatcagagtccatatggagttactgctgtggatttttcaattggagcacctaaccttttagccgttggctatcacaatggcacaattgcaatttacaatgtacggagcaacagtaatgttccagttctggatagtagtgaatcacctcaaaaacatttgggacctgtatggcaactacagtggatagaacaagatcgaggaacaacaggagatggcaaaagagaaatactagtttctatatcagcagatggaagaatctccaaatgggttatacgaaaaggactagactgttatgatttgatgcgattaaagagaactacagctgccagtaacaaaaaaggaggggaaaaggaaaagaaagatgaagctttgatatctcgacaggctcctggaatgtgttttgcttttcatcccaaggacacaaatatctatttggctggcactgaagaaggtcatattcacaaatgttcttgttcatataatgaacaatacttagatacctacagagggtccagtgtataaagtgacatggaatccattttgtcatgatgtatttttaagctgttctgcagattggggtgttattatatggcaacaggagaatgtcaagccatctttgagtttttatccagctacttctgttgtttacgacgttgcctggtctccaaaatcatcctatatatttgcagctgcaaatgagaacagggtggagatttgggaccttcatatcagcactttggaccctctgattgtgaatactgctaaccctggaatcaagttcacaaccattctctttgccaaacaaacagattgccttctggtaggagacagtgatggacaggtttctgtgtatgaactgagaaatatgcctactgttttggaaactggccggggagatataatggatactttgcttggatccaagtcaaaccaatcagcataattcatcattcctaatatttttcttgtagttgttttaaaaaaggaattaacatccaatattctgtattacatactgtacaccagattttgatttcagaaaacaatatttgatgtataacttccacttaatttaaatttaataaacttttatttcagagatatttgattagtttacaatctaagagttattcttaagagtttcagtggaattttcttaatttttctaaagatattcctactctcttgatcatattctaagtacatatgagtacatgtacattcttatacaatgtctaaatgggttagaaaattattatacctatagaagcgaaacttggaaattaatagaatcacttaaaccaaaatctttataagacacaattctattgattttaaagcttctgctttccaggctctgttttccagagtttataattacgtagtttttagtagatgaaaataatggattcttgtacctaacattttatcctcttagatctaagagccgaagctatagaactttgttagactatttggcaagcaaaatatatgacagtaaatatcagaattttatggtttgaccagcgcttatcacattcccaattcagtgagaaaaattcatctgggacacaacagggtactcttctctgtttgcccagaatcagctctggattttaagcccagacttcagtggacccagatagaaaatataaagtctctgatctataggccacatcaggatgttattttatgaagagttctagagcaaggttgcggaaatcggggtggagatggggagcagtgactcctccaaatattcattgctaacaggccattctatgcagtttgttttaacaaatcctgggttaaactgaggccacaggacatgatgggctgttctataaagcattctaagtggagaggagacgatagggcatatgaaattcactaaactctctggaaaaaaaatatgtatatattaaaaaccaagactggaatcagtgcaacagtgggaactaccttttacaagtatccattgcttcataaactccatttgtttggaccaatcccttaaacaaaagcaaggcaaattttacatggatttagagcctaggtcaggttattaggattataaattttccactggtatgtcattgtgattatctttgtttttgtctttctgaaagattggattttctataacaccttgtgtaagaaaataaaaaacttgatctaactgaaaaatgtgt

SEQ ID NO: 298087 - DNA, 2901 bp, Homo sapiens
gttgtaatctcctacctcttttgtggtccgcgaacgcgccaacatcattttcagcataatgtccactgcctgggatttgtatgattcttacaatgctatggaacttgtatctttatcagtaaaacaatctgtggttgagtcaagtagtaaagcaaatgtacttcctaaagatcaggaccaaagattgccagggagcactacagaaaaaaatagtgaaactagttctctaatggacatagaaaatgtaattctggcaaaaatccatgaagatgaggaagaccactcagatgcaatattaaaatctgacaaatttcatcaggacttattttttatggaacgggttctgatggaaaatatatttcagcccaaacttgcagcttatcgtcagcttcctgttttaaaagaacctgaacctgaagagcctgaagatgttttagaaagtgcaaaacatgaagaggtagaggaagaatctaagaaggaggaggaagaagaaatacatgcagaagaatcaacaatacccgccaacttggaacgactttggtctttttcctgtgacttaaccaaaggcctcaatgtgagcagccttgcctggaataaaacaaatccagatcttttggctgttggctatgggcactttggatttaaagagcaaaaaagaggactggcttgctgctggtcaataaagaatcccatgtggccagaacgtatttatcagagtccatatggagttactgctgtggatttttcaattggagcacctaaccttttagccgttggctatcacaatggcacaattgcaatttacaatgtacggagcaacagtaatgttccagttctggatagtagtgaatcacctcaaaaacatttgggacctgtatggcaactacagtggatagaacaagatcgaggaacaacaggagatggcaaaagagaaatactagtttctatatcagcagatggaagaatctccaaatgggttatacgaaaaggactagactgttatgatttgatgcgattaaagagaactacagctgccagtaacaaaaaaggaggggaaaaggaaaagaaagatgaagctttgatatctcgacaggctcctggaatgtgttttgcttttcatcccaaggacacaaatatctatttggctggcactgaagaaggtcatattcacaaatgttcttgttcatataatgaacaatacttagatacctacagagggtccagtgtataaagtgacatggaatccattttgtcatgatgtatttttaagctgttctgcagattggggtgttattatatggcaacaggagaatgtcaagccatctttgagtttttatccagctacttctgttgtttacgacgttgcctggtctccaaaatcatcctatatatttgcagctgcaaatgagaacagggtggagatttgggaccttcatatcagcactttggaccctctgattgtgaatactgctaaccctggaatcaagttcacaaccattctctttgccaaacaaacagattgccttctggtaggagacagtgatggacaggtttctgtgtatgaactgagaaatatgcctactgttttggaaactggccggggagatataatggatactttgcttggatccaagtcaaaccaatcagcataattcatcattcctaatatttttcttgtagttgttttaaaaaaggaattaacatccaatattctgtattacatactgtacaccagattttgatttcagaaaacaatatttgatgtataacttccacttaatttaaatttaataaacttttatttcagagatatttgattagtttacaatctaagagttattcttaagagtttcagtggaattttcttaatttttctaaagatattcctactctcttgatcatattctaagtacatatgagtacatgtacattcttatacaatgtctaaatgggttagaaaattattatacctatagaagcgaaacttggaaattaatagaatcacttaaaccaaaatctttataagacacaattctattgattttaaagcttctgctttccaggctctgttttccagagtttataattacgtagtttttagtagatgaaaataatggattcttgtacctaacattttatcctcttagatctaagagccgaagctatagaactttgttagactatttggcaagcaaaatatatgacagtaaatatcagaattttatggtttgaccagcgcttatcacattcccaattcagtgagaaaaattcatctgggacacaacagggtactcttctctgtttgcccagaatcagctctggattttaagcccagacttcagtggacccagatagaaaatataaagtctctgatctataggccacatcaggatgttattttatgaagagttctagagcaaggttgcggaaatcggggtggagatggggagcagtgactcctccaaatattcattgctaacaggccattctatgcagtttgttttaacaaatcctgggttaaactgaggccacaggacatgatgggctgttctataaagcattctaagtggagaggagacgatagggcatatgaaattcactaaactctctggaaaaaaaatatgtatatattaaaaaccaagactggaatcagtgcaacagtgggaactaccttttacaagtatccattgcttcataaactccatttgtttggaccaatcccttaaacaaaagcaaggcaaattttacatggatttagagcctaggtcaggttattaggattataaattttccactggtatgtcattgtgattatctttgtttttgtctttctgaaagattggattttctataacaccttgtgtaagaaaataaaaaacttgatctaactgaaaaatgtgt

SEQ ID NO: 298088 - DNA, 1737 bp, Homo sapiens
cgtacgtcgatggggagacgtgtatcgcaatacaaaaaagccacgactttaagggtccagtgtataaagtgacatggaatccattttgtcatgatgtatttttaagctgttctgcagattggggtgttattatatggcaacaggagaatgtcaagccatctttgagtttttatccagctacttctgttgtttacgacgttgcctggtctccaaaatcatcctatatatttgcagctgcaaatgagaacagggtggagatttgggaccttcatatcagcactttggaccctctgattgtgaatactgctaaccctggaatcaagttcacaaccattctctttgccaaacaaacagattgccttctggtaggagacagtgatggacaggtttctgtgtatgaactgagaaatatgcctactgttttggaaactggccggggagatataatggatactttgcttggatccaagtcaaaccaatcagcataattcatcattcctaatatttttcttgtagttgttttaaaaaaggaattaacatccaatattctgtattacatactgtacaccagattttgatttcagaaaacaatatttgatgtataacttccacttaatttaaatttaataaacttttatttcagagatatttgattagtttacaatctaagagttattcttaagagtttcagtggaattttcttaatttttctaaagatattcctactctcttgatcatattctaagtacatatgagtacatgtacattcttatacaatgtctaaatgggttagaaaattattatacctatagaagcgaaacttggaaattaatagaatcacttaaaccaaaatctttataagacacaattctattgattttaaagcttctgctttccaggctctgttttccagagtttataattacgtagtttttagtagatgaaaataatggattcttgtacctaacattttatcctcttagatctaagagccgaagctatagaactttgttagactatttggcaagcaaaatatatgacagtaaatatcagaattttatggtttgaccagcgcttatcacattcccaattcagtgagaaaaattcatctgggacacaacagggtactcttctctgtttgcccagaatcagctctggattttaagcccagacttcagtggacccagatagaaaatataaagtctctgatctataggccacatcaggatgttattttatgaagagttctagagcaaggttgcggaaatcggggtggagatggggagcagtgactcctccaaatattcattgctaacaggccattctatgcagtttgttttaacaaatcctgggttaaactgaggccacaggacatgatgggctgttctataaagcattctaagtggagaggagacgatagggcatatgaaattcactaaactctctggaaaaaaaatatgtatatattaaaaaccaagactggaatcagtgcaacagtgggaactaccttttacaagtatccattgcttcataaactccatttgtttggaccaatcccttaaacaaaagcaaggcaaattttacatggatttagagcctaggtcaggttattaggattataaattttccactggtatgtcattgtgattatctttgtttttgtctttctgaaagattggattttctataacaccttgtgtaagaaaataaaaaacttgatctaactgaaaaatgtgt

SEQ ID NO: 298089 - DNA, 1935 bp, Homo sapiens
attggtatattcaagatagtgtttttattttgggttcttgaattgattttaatagatccagaaatatctaatcttctatttatcacacttactaatgtatcacaagccaatgcatttcgatgttttgtgttgtaggacacaaatatctatttggctggcactgaagaaggtcatattcacaaatgttcttgttcatataatgaacaatacttagatacctacagagctatgtattttttttttatttctagggtccagtgtataaagtgacatggaatccattttgtcatgatgtatttttaagctgttctgcagattggggtgttattatatggcaacaggagaatgtcaagccatctttgagtttttatccagctacttctgttgtttacgacgttgcctggtctccaaaatcatcctatatatttgcagctgcaaatgagaacagggtggagatttgggaccttcatatcagcactttggaccctctgattgtgaatactgctaaccctggaatcaagttcacaaccattctctttgccaaacaaacagattgccttctggtaggagacagtgatggacaggtttctgtgtatgaactgagaaatatgcctactgttttggaaactggccggggagatataatggatactttgcttggatccaagtcaaaccaatcagcataattcatcattcctaatatttttcttgtagttgttttaaaaaaggaattaacatccaatattctgtattacatactgtacaccagattttgatttcagaaaacaatatttgatgtataacttccacttaatttaaatttaataaacttttatttcagagatatttgattagtttacaatctaagagttattcttaagagtttcagtggaattttcttaatttttctaaagatattcctactctcttgatcatattctaagtacatatgagtacatgtacattcttatacaatgtctaaatgggttagaaaattattatacctatagaagcgaaacttggaaattaatagaatcacttaaaccaaaatctttataagacacaattctattgattttaaagcttctgctttccaggctctgttttccagagtttataattacgtagtttttagtagatgaaaataatggattcttgtacctaacattttatcctcttagatctaagagccgaagctatagaactttgttagactatttggcaagcaaaatatatgacagtaaatatcagaattttatggtttgaccagcgcttatcacattcccaattcagtgagaaaaattcatctgggacacaacagggtactcttctctgtttgcccagaatcagctctggattttaagcccagacttcagtggacccagatagaaaatataaagtctctgatctataggccacatcaggatgttattttatgaagagttctagagcaaggttgcggaaatcggggtggagatggggagcagtgactcctccaaatattcattgctaacaggccattctatgcagtttgttttaacaaatcctgggttaaactgaggccacaggacatgatgggctgttctataaagcattctaagtggagaggagacgatagggcatatgaaattcactaaactctctggaaaaaaaatatgtatatattaaaaaccaagactggaatcagtgcaacagtgggaactaccttttacaagtatccattgcttcataaactccatttgtttggaccaatcccttaaacaaaagcaaggcaaattttacatggatttagagcctaggtcaggttattaggattataaattttccactggtatgtcattgtgattatctttgtttttgtctttctgaaagattggattttctataacaccttgtgtaagaaaataaaaaacttgatctaactgaaaaatgtgt

SEQ ID NO: 298090 - DNA, 2498 bp, Homo sapiens
gcccggcaaacattccggagcctcggcccgagccgctaacgcaggagcttgggggtacagggacttcagaggcggccaaaaaaaggggtggtggaccactccccagctggtcgccaccatgccagtctctccggcaggcagtcacaagcagcagaacttcgggttgaacaatgccacacaaccaaagaagtctattagcttttttgctacaatgaaagcaacttcagtgaaaggatatactggtgcaaatcaaagcagaatggctgtgtccaaaaccgtgcttattccacctgaactgaaaactgtagaaaaaccaaatcccaatataaagacaacacaggtatttgacataaatggaactgatgttactccccgacctctttaccatccagatccacttactggtacagcaaaaccaagtaaactcttgacatcacaagaaggatcacttggatcagaatttatatcttcctatagcctttatcagaatacaataaatcctagtacgttagggcagtttacaaggtcagttttaggaagcagtacagtttctaagtcaagtgtatcagcaagtgaatcaatagcagaagacctggaagaaccatcctataaacgggaaagattgactagtttcacagatttgcaagttataagggcagcacctgaaaaaattgtaacaaaagaagacctggagaagaatatagagataatactcacagagacagaaacactgagattttttgacttgcccacagtcatggtctctgtagaatctgaagaagctgagaaagtaactcagagaaacaagaattatgaagtcctttgtagaaacagattaggcaatgacctatatgttgaaaggatgatgcagactttcaatggagcaccaaagaataaagatgttcaatgtgataaaatcataatggaagataaaggcataatgtccactgcctgggatttgtatgattcttacaatgctatggaacttgtatctttatcagtaaaacaatctgtggttgagtcaagtagtaaagcaaatgtacttcctaaagatcaggaccaaagattgccagggagcactacagaaaaaaaacctgaacctgaagagcctgaagatgttttagaaagtgcaaaacatgaagaggtagaggaagaatctaagaaggaggaggaagaagaaatacatgcagaagaatcaacaatacccgccaacttggaacgactttggtctttttcctgtgacttaaccaaaggcctcaatgtgagcagccttgcctggaataaaacaaatccagatcttttggctgttggctatgggcactttggatttaaagagcaaaaaagaggactggcttgctgctggtcaataaagaatcccatgtggccagaacgtatttatcagagtccatatggagttactgctgtggatttttcaattggagcacctaaccttttagccgttggctatcacaatggcacaattgcaatttacaatgtacggagcaacagtaatgttccagttctggatagtagtgaatcacctcaaaaacatttgggacctgtatggcaactacagtggatagaacaagatcgaggaacaacaggagatggcaaaagagaaatactagtttctatatcagcagatggaagaatctccaaatgggttatacgaaaaggactagactgttatgatttgatgcgattaaagagaactacagctgccagtaacaaaaaaggaggggaaaaggaaaagaaagatgaagctttgatatctcgacaggctcctggaatgtgttttgcttttcatcccaaggacacaaatatctatttggctggcactgaagaaggtcatattcacaaatgttcttgttcatataatgaacaatacttagatacctacagagggtccagtgtataaagtgacatggaatccattttgtcatgatgtatttttaagctgttctgcagattggggtgttattatatggcaacaggagaatgtcaagccatctttgagtttttatccagctacttctgttgtttacgacgttgcctggtctccaaaatcatcctatatatttgcagctgcaaatgagaacagggtggagatttgggaccttcatatcagcactttggaccctctgattgtgaatactgctaaccctggaatcaagttcacaaccattctctttgccaaacaaacagattgccttctggtaggagacagtgatggacaggtttctgtgtatgaactgagaaatatgcctactgttttggaaactggccggggagatataatggatactttgcttggatccaagtcaaaccaatcagcataattcatcattcctaatatttttcttgtagttgttttaaaaaaggaattaacatccaatattctgtattacatactgtacaccagattttgatttcagaaaacaatatttgatgtataacttccacttaatttaaatttaataaacttttatttcagagat

SEQ ID NO: 298091 - DNA, 1684 bp, Homo sapiens
gcccggcaaacattccggagcctcggcccgagccgctaacgcaggagcttgggggtacagggacttcagaggcggccaaaaaaaggggtggtggaccactccccagctggtcgccaccatgccagtctctccggcaggcagtcacaagcagcagaacttcgggttgaacaatgccacacaaccaaagaagtctattagcttttttgctacaatgaaagcaacttcagtgaaaggatatactggtgcaaatcaaagcagaatggctgtgtccaaaaccgtgcttattccacctgaactgaaaactgtagaaaaaccaaatcccaatataaagacaacacaggtatttgacataaatggaactgatgttactccccgacctctttaccatccagatccacttactggtacagcaaaaccaagtaaactcttgacatcacaagaaggatcacttggatcagaatttatatcttcctatagcctttatcagaatacaataaatcctagtacgttagggcagtttacaaggtcagttttaggaagcagtacagtttctaagtcaagtgtatcagcaagtgaatcaatagcagaagacctggaagaaccatcctataaacgggaaagattgactagtttcacagatttgcaagttataagggcagcacctgaaaaaattgtaacaaaagaagacctggagaagaatatagagataatactcacagagacagaaacactgagattttttgacttgcccacagtcatggtctctgtagaatctgaagaagctgagaaagtaactcagagaaacaagaattatgaagtcctttgtagaaacagattaggcaatgacctatatgttgaaaggatgatgcagactttcaatggagcaccaaagaataaagatgttcaatgtgataaaatcataatggaagataaaggcataatgtccactgcctgggatttgtatgattcttacaatgctatggaacttgtatctttatcagtaaaacaatctgtggttgagtcaagtagtaaagcaaatgtacttcctaaagatcaggaccaaagattgccagggagcactacagaaaaaaatagtgaaactagttctctaatggacatagaaaatgtaattctggcaaaaatccatgaagatgaggaagaccactcagatgcaatattaaaatctgacaaatttcatcaggacttattttttatggaacgggttctgatggaaaatatatttcagcccaaacttgcagcttatcgtcagcttcctgttttaaaagaacctgaacctgaagagcctgaagatgttttagaaagtgcaaaacatgaagaggtagaggaagaatctaagaaggaggaggaagaagaaatacatgcagaagaatcaacaatacccgccaacttggaacgactttggtctttttcctgtgacttaaccaaaggcctcaatgtgagcagccttgcctggaataaaacaaatccagatcttttggctgttggctatgggcactttggatttaaagagcaaaaaagaggactggcttgctgctggtcaataaagaatcccatggtaacccaaacaagaataagaagcatttttatctggctgttgacaaaattctcataaaatatataattacatgtaataattaaataaagtctagaaaattttatcaat

SEQ ID NO: 298092 - DNA, 1489 bp, Homo sapiens
gcccggcaaacattccggagcctcggcccgagccgctaacgcaggagcttgggggtacagggacttcagaggcggccaaaaaaaggggtggtggaccactccccagctggtcgccaccatgccagtctctccggcaggcagtcacaagcagcagaacttcgggttgaacaatgccacacaaccaaagaagtctattagcttttttgctacaatgaaagcaacttcagtgaaaggatatactggtgcaaatcaaagcagaatggctgtgtccaaaaccgtgcttattccacctgaactgaaaactgtagaaaaaccaaatcccaatataaagacaacacaggtatttgacataaatggaactgatgttactccccgacctctttaccatccagatccacttactggtacagcaaaaccaagtaaactcttgacatcacaagaaggatcacttggatcagaatttatatcttcctatagcctttatcagaatacaataaatcctagtacgttagggcagtttacaaggtcagttttaggaagcagtacagtttctaagtcaagtgtatcagcaagtgaatcaatagcagaagacctggaagaaccatcctataaacgggaaagattgactagtttcacagatttgcaagttataagggcagcacctgaaaaaattgtaacaaaagaagacctggagaagaatatagagataatactcacagagacagaaacactgagattttttgacttgcccacagtcatggtctctgtagaatctgaagaagctgagaaagtaactcagagaaacaagaattatgaagtcctttgtagaaacagattaggcaatgacctatatgttgaaaggatgatgcagactttcaatggagcaccaaagaataaagatgttcaatgtgataaaatcataatggaagataaaggcataatgtccactgcctgggatttgtatgattcttacaatgctatggaacttgtatctttatcagtaaaacaatctgtggttgagtcaagtagtaaagcaaatgtacttcctaaagatcaggaccaaagattgccagggagcactacagaaaaaaaacctgaacctgaagagcctgaagatgttttagaaagtgcaaaacatgaagaggtagaggaagaatctaagaaggaggaggaagaagaaatacatgcagaagaatcaacaatacccgccaacttggaacgactttggtctttttcctgtgacttaaccaaaggcctcaatgtgagcagccttgcctggaataaaacaaatccagatcttttggctgttggctatgggcactttggatttaaagagcaaaaaagaggactggcttgctgctggtcaataaagaatcccatggtaacccaaacaagaataagaagcatttttatctggctgttgacaaaattctcataaaatatataattacatgtaataattaaataaagtctagaaaattttatcaat

SEQ ID NO: 298093 - DNA, 1218 bp, Homo sapiens
gcccggcaaacattccggagcctcggcccgagccgctaacgcaggagcttgggggtacagggacttcagaggcggccaaaaaaaggggtggtggaccactccccagctggtcgccaccatgccagtctctccggcaggcagtcacaagcagcagaacttcgggttgaacaatgccacacaaccaaagaagtctattagcttttttgctacaatgaaagcaacttcagtgaaaggatatactggtgcaaatcaaagcagaatggctgtgtccaaaaccgtgcttattccacctgaactgaaaactgtagaaaaaccaaatcccaatataaagacaacacaggtatttgacataaatggaactgatgttactccccgacctctttaccatccagatccacttactggtacagcaaaaccaagtaaactcttgacatcacaagaaggatcacttggatcagaatttatatcttcctatagcctttatcagaatacaataaatcctagtacgttagggcagtttacaaggtcagttttaggaagcagtacagtttctaagtcaagtgtatcagcaagtgaatcaatagcagaagacctggaagaaccatcctataaacgggaaagattgactagtttcacagatttgcaagttataagggcagcacctgaaaaaattgtaacaaaagaagacctggagaagaatatagagataatactcacagagacagaaacactgagattttttgacttgcccacagtcatggtctctgtagaatctgaagaagctgagaaagtaactcagagaaacaagaattatgaagtcctttgtagaaacagattaggcaatgacctatatgttgaaaggatgatgcagactttcaatggagcaccaaagaataaagatgttcaatgtgataaaatcataatggaagataaaggcataatgtccactgcctgggatttgtatgattcttacaatgctatggaacttgtatctttatcagtaaaacaatctgtggttgagtcaagtagtaaagcaaatgtacttcctaaagatcaggaccaaagattgccagggagcactacagaaaaaagtttgcttgtagaagctatcaaaaactgctcagaacaatccaatcttagactggaaattacactgggactttatattagatcgatcttttccacaccattaaggccattgacctacaaaaatgtgcg

SEQ ID NO: 298094 - DNA, 2965 bp, Homo sapiens
  misc_feature (697)..(697): n is a, c, g, or t
aggtctggacctgaaccgagacaaggaggtaccacactattcactgctgcgtcgcagagcgggctgggcggctgtctggacctcgagaggcctgaggcaaggatcgcgtcagaccccgaaagctggtttgttgattagtgatctaagaccgccggaagcgcttcttctcaatcaagctatgcaacaggaagtcattacgatcccgttgtaacctctaaatatgtccccgttctgcacagcatcccgataaccgttttgtttttctcatattatgaccttctcatgttagcaccacttcgcaacgctccaggtcgtgaaggagcaacttcaccatcgccgcctacagacgccactgggagcttgggagagtgggacgtggacaggaacgtaaagaccgaagggtgggtttcgaaggagcggatttcgaagttgcaccggttgaggatggctgacattctctctcagtcagagaccctggcgtcgcaagacctcagtggggacttcaagaagccagctctgccggtgtccccagcggcgcggagtaaggccccggccagcagttcttcaaaccctgaggaggtacagaaggaagggcccactgcgttgcaggactccaattctggggagcccgacatccctcctcctcagccggactgcggtgattttaggagtctacaggaggagcagtcgcgccccncgacagcggtttcttcccctggcggtccagcccgggctcccccctaccaagagcctccatggggtggccctgccacagccccctacagcttagagaccctgaagggcggcactatccttggcacccgtagcttgaaagggacgagttactgccttttcgggaggctgtctggctgcgacgtgtgcctggagcacccttcggtgtctcggtaccacgcagtgctgcagcacagggcgtccggccctgacggagaatgcgacagcaacgggccgggcttctacctctacgatctgggaagcacccatggcacttttctcaacaaaactcgcatcccacctcgcacctactgtcgagtccacgttgggcatgttgttcgctttggaggcagcacccggctctttatcctgcagggaccagaggaagaccgagaggcagaatccgagttaacagtaacacagttgaaggaattgcgcaagcagcagcaaatattgttggagaagaagatgctaggagaagactcagatgaagaagaggaaatggatacctctgaaaggaagataaatgctggtagccaagatgatgagatgggttgcacctggggaatgggagaagatgcagtagaggatgatgctgaagagaaccctattgtcttagagtttcagcaggaaagggaggccttttatataaaggatcccaaaaaggctctccaaggcttttttgaccgagaaggagaagaattagaatatgaatttgatgaacagggacatagcacttggctctgcagggtgagattacctgtggacgattcaactggaaaacaactggtggctgaggccattcactcaggaaagaaaaaagaagcaatgatccagtgctcattggaagcttgtcggattcttgacactttgggattgcttcggcaggaagcagtatctcggaaaaggaaagccaagaactgggaagatgaagacttttatgatagtgatgatgacacatttcttgataggactggcctgattgagaagaagcgtctgaacagaatgaagaaggctggcaagattgatgagaagccagagacctttgaatcattggttgcaaaattaaatgatgctgaaagggaactttctgaaatttctgagagattgaaagcctcaagccaagttctatcagagtctccatctcaggattctttagatgcgttcatgtcagaaatgaaatcaggcagtacattagatggtgtgtcccggaagaaacttcacctgagaacttttgaactgaggaaagaacaacagagacttaaagggttaataaaaattgtaaagccagcagagattccagaactaaaaaagactgaaactcagactacaggtgcagaaaacaaagctaaaaagcttacattgcctctatttggtgccatgaaaggaggaagcaaattcaaattaaaaactggaacagtagggaagttaccccccaagcgtccagaactccctccaactctaatgagaatgaaagatgagcctgaagtagaagaggaggaggaagaggaagaggaagaagagaaagaaaaggaggagcatgaaaagaaaaaactggaggatggaagcctcagtaggccacagccagagatagagccagaagcagcagtgcaggaaatgaggcctcccacagatctcacacattttaaagaaacccaaacccatgaaaacatgtctcaacttagcgaggaagaacagaataaagattatcaagactgtagcaaaaccacttcattgtgcgcaggaccctcagcatcaaagaatgaatatgagaaaagcagaggtgaattgaagaaaaagaaaacacctggtccaggcaaacttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaatgtcct

SEQ ID NO: 298095 - DNA, 463 bp, Homo sapiens
gtgaaaatgtaaaaaggaatatgcacaaagcaaaaaaaaagaggcaactttcttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaatgtcct

SEQ ID NO: 298096 - DNA, 456 bp, Homo sapiens
  misc_feature (27)..(28): n is a, c, g, or t
  misc_feature (36)..(36): n is a, c, g, or t
  misc_feature (40)..(42): n is a, c, g, or t
aaaaaaataaaaatctccaaaattaannaaaaaaanaaannnttcttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaatgtcct

SEQ ID NO: 298097 - DNA, 466 bp, Homo sapiens
taacgttacctcaaataaagaaaattaataagaggaaaaaaggggaagaactcacttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaatgtcct

SEQ ID NO: 298098 - DNA, 469 bp, Homo sapiens
tatatttcattccctactcaccatcaactgtaatgcaaaacgaggagaaggccgttacttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaatgtcct

SEQ ID NO: 298099 - DNA, 456 bp, Homo sapiens
ttgcatagtccattcagacacccatcctatacgtaacaaaccctcttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaatgtcct

SEQ ID NO: 298100 - DNA, 465 bp, Homo sapiens
tttataactacttacatatttttcgatttctatcatcaaaagagaaatttctacttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaatgtcct

SEQ ID NO: 298101 - DNA, 459 bp, Homo sapiens
cgcccaccaccatcatccaattcagatgggaaaagggcgccggttcacttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaatgtcct

SEQ ID NO: 298102 - DNA, 463 bp, Homo sapiens
aagcaaaaaaatagattaacaagtaaataacaacaacccaaaaaaaatttacttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaatgtcct

SEQ ID NO: 298103 - DNA, 1462 bp, Homo sapiens
gctgatctagaggaccccggtcacctgcaacaccactcaggaaagaaaaaagaagcaatgatccagtgctcattggaagcttgtcggattcttgacactttgggattgcttcggcaggaagcagtatctcggaaaaggaaagccaagaactgggaagatgaagacttttatgatagtgatgatgacacatttcttgataggactggcctgattgagaagaagcgtctgaacagaatgaagaaggctggcaagattgatgagaagccagagacctttgaatcattggttgcaaaattaaatgatgctgaaagggaactttctgaaatttctgagagattgaaagcctcaagccaagttctatcagagtctccatctcaggattctttagatgcgttcatgtcagaaatgaaatcaggcagtacattagatggtgtgtcccggaagaaacttcacctgagaacttttgaactgaggaaagaacaacagagacttaaagggttaataaaaattgtaaagccagcagagattccagaactaaaaaagactgaaactcagactacaggtgcagaaaacaaagctaaaaagcttacattgcctctatttggtgccatgaaaggaggaagcaaattcaaattaaaaactggaacagtagggaagttaccccccaagcgtccagaactccctccaactctaatgagaatgaaagatgagcctgaagtagaagaggaggaggaagaggaagaggaagaagagaaagaaaaggaggagcatgaaaagaaaaaactggaggatggaagcctcagtaggccacagccagagatagagccagaagcagcagtgcaggaaatgaggcctcccacagatctcacacattttaaagaaacccaaacccatgaaaacatgtctcaacttagcgaggaagaacagaataaagattatcaagactgtagcaaaaccacttcattgtgcgcaggaccctcagcatcaaagaatgaatatgagaaaagcagaggtgaattgaagaaaaagaaaacacctggtccaggcaaacttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaatgtcct

SEQ ID NO: 298104 - DNA, 477 bp, Homo sapiens
ttgttcgctcattggaccgcatggtcgcccccacggtgtttgtaaaggtggaggagaaattttaacttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaatgtcct

SEQ ID NO: 298105 - DNA, 452 bp, Homo sapiens
ttattatatgagtttgagtttataaccaagagaagtcctacttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaatgtcct

SEQ ID NO: 298106 - DNA, 3402 bp, Homo sapiens
  misc_feature (697)..(697): n is a, c, g, or t
aggtctggacctgaaccgagacaaggaggtaccacactattcactgctgcgtcgcagagcgggctgggcggctgtctggacctcgagaggcctgaggcaaggatcgcgtcagaccccgaaagctggtttgttgattagtgatctaagaccgccggaagcgcttcttctcaatcaagctatgcaacaggaagtcattacgatcccgttgtaacctctaaatatgtccccgttctgcacagcatcccgataaccgttttgtttttctcatattatgaccttctcatgttagcaccacttcgcaacgctccaggtcgtgaaggagcaacttcaccatcgccgcctacagacgccactgggagcttgggagagtgggacgtggacaggaacgtaaagaccgaagggtgggtttcgaaggagcggatttcgaagttgcaccggttgaggatggctgacattctctctcagtcagagaccctggcgtcgcaagacctcagtggggacttcaagaagccagctctgccggtgtccccagcggcgcggagtaaggccccggccagcagttcttcaaaccctgaggaggtacagaaggaagggcccactgcgttgcaggactccaattctggggagcccgacatccctcctcctcagccggactgcggtgattttaggagtctacaggaggagcagtcgcgccccncgacagcggtttcttcccctggcggtccagcccgggctcccccctaccaagagcctccatggggtggccctgccacagccccctacagcttagagaccctgaagggcggcactatccttggcacccgtagcttgaaagggacgagttactgccttttcgggaggctgtctggctgcgacgtgtgcctggagcacccttcggtgtctcggtaccacgcagtgctgcagcacagggcgtccggccctgacggagaatgcgacagcaacgggccgggcttctacctctacgatctgggaagcacccatggcacttttctcaacaaaactcgcatcccacctcgcacctactgtcgagtccacgttgggcatgttgttcgctttggaggcagcacccggctctttatcctgcagggaccagaggaagaccgagaggcagaatccgagttaacagtaacacagttgaaggaattgcgcaagcagcagcaaatattgttggagaagaagatgctaggagaagactcagatgaagaagaggaaatggatacctctgaaaggaagataaatgctggtagccaagatgatgagatgggttgcacctggggaatgggagaagatgcagtagaggatgatgctgaagagaaccctattgtcttagagtttcagcaggaaagggaggccttttatataaaggatcccaaaaaggctctccaaggcttttttgaccgagaaggagaagaattagaatatgaatttgatgaacagggacatagcacttggctctgcagggtgagattacctgtggacgattcaactggaaaacaactggtggctgaggccattcactcaggaaagaaaaaagaagcaatgatccagtgctcattggaagcttgtcggattcttgacactttgggattgcttcggcaggaagcagtatctcggaaaaggaaagccaagaactgggaagatgaagacttttatgatagtgatgatgacacatttcttgataggactggcctgattgagaagaagcgtctgaacagaatgaagaaggctggcaagattgatgagaagccagagacctttgaatcattggttgcaaaattaaatgatgctgaaagggaactttctgaaatttctgagagattgaaagcctcaagccaagttctatcagagtctccatctcaggattctttagatgcgttcatgtcagaaatgaaatcaggcagtacattagatggtgtgtcccggaagaaacttcacctgagaacttttgaactgaggaaagaacaacagagacttaaagggttaataaaaattgtaaagccagcagagattccagaactaaaaaagactgaaactcagactacaggtgcagaaaacaaagctaaaaagcttacattgcctctatttggtgccatgaaaggaggaagcaaattcaaattaaaaactggaacagtagggaagttaccccccaagcgtccagaactccctccaactctaatgagaatgaaagatgagcctgaagtagaagaggaggaggaagaggaagaggaagaagagaaagaaaaggaggagcatgaaaagaaaaaactggaggatggaagcctcagtaggccacagccagagatagagccagaagcagcagtgcaggaaatgaggcctcccacagatctcacacattttaaagaaacccaaacccatgaaaacatgtctcaacttagcgaggaagaacagaataaagattatcaagactgtagcaaaaccacttcattgtgcgcaggaccctcagcatcaaagaatgaatatgagaaaagcagaggtgaattgaagaaaaagaaaacacctggtccaggcaaacttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaatgtcctaaacaaagaaaatggcctcggtgggctacaatggcggcatttctgggtacgctagcctttagggaggattcctttatgattccattattgctgagtcatctgcccttagacgtatagaatagctgaactaggcaaaaagtgcctactatgccgtgctctgtgcaaaccacgcataacactgctcccgttaggcgacacacatgtcgcttctcagtgcattgaccggccacaacctgtaattatgtatattatccacgccactcttgatcgttgttcttttgctactcaatatccccatcctgaccgcttatcccacaataccgcatcccccacggctattcaaagcttccccgccattatgagatatagaatcgagcgagtacagattcccctctcgacacttgtcctgcccgatcagcctacatatatcgaattta

SEQ ID NO: 298107 - DNA, 3337 bp, Homo sapiens
  misc_feature (697)..(697): n is a, c, g, or t
aggtctggacctgaaccgagacaaggaggtaccacactattcactgctgcgtcgcagagcgggctgggcggctgtctggacctcgagaggcctgaggcaaggatcgcgtcagaccccgaaagctggtttgttgattagtgatctaagaccgccggaagcgcttcttctcaatcaagctatgcaacaggaagtcattacgatcccgttgtaacctctaaatatgtccccgttctgcacagcatcccgataaccgttttgtttttctcatattatgaccttctcatgttagcaccacttcgcaacgctccaggtcgtgaaggagcaacttcaccatcgccgcctacagacgccactgggagcttgggagagtgggacgtggacaggaacgtaaagaccgaagggtgggtttcgaaggagcggatttcgaagttgcaccggttgaggatggctgacattctctctcagtcagagaccctggcgtcgcaagacctcagtggggacttcaagaagccagctctgccggtgtccccagcggcgcggagtaaggccccggccagcagttcttcaaaccctgaggaggtacagaaggaagggcccactgcgttgcaggactccaattctggggagcccgacatccctcctcctcagccggactgcggtgattttaggagtctacaggaggagcagtcgcgccccncgacagcggtttcttcccctggcggtccagcccgggctcccccctaccaagagcctccatggggtggccctgccacagccccctacagcttagagaccctgaagggcggcactatccttggcacccgtagcttgaaagggacgagttactgccttttcgggaggctgtctggctgcgacgtgtgcctggagcacccttcggtgtctcggtaccacgcagtgctgcagcacagggcgtccggccctgacggagaatgcgacagcaacgggccgggcttctacctctacgatctgggaagcacccatggcacttttctcaacaaaactcgcatcccacctcgcacctactgtcgagtccacgttgggcatgttgttcgctttggaggcagcacccggctctttatcctgcagggaccagaggaagaccgagaggcagaatccgagttaacagtaacacagttgaaggaattgcgcaagcagcagcaaatattgttggagaagaagatgctaggagaagactcagatgaagaagaggaaatggatacctctgaaaggaagataaatgctggtagccaagatgatgagatgggttgcacctggggaatgggagaagatgcagtagaggatgatgctgaagagaaccctattgtcttagagtttcagcaggaaagggaggccttttatataaaggatcccaaaaaggctctccaaggcttttttgaccgagaaggagaagaattagaatatgaatttgatgaacagggacatagcacttggctctgcagggtgagattacctgtggacgattcaactggaaaacaactggtggctgaggccattcactcaggaaagaaaaaagaagcaatgatccagtgctcattggaagcttgtcggattcttgacactttgggattgcttcggcaggaagcagtatctcggaaaaggaaagccaagaactgggaagatgaagacttttatgatagtgatgatgacacatttcttgataggactggcctgattgagaagaagcgtctgaacagaatgaagaaggctggcaagattgatgagaagccagagacctttgaatcattggttgcaaaattaaatgatgctgaaagggaactttctgaaatttctgagagattgaaagcctcaagccaagttctatcagagtctccatctcaggattctttagatgcgttcatgtcagaaatgaaatcaggcagtacattagatggtgtgtcccggaagaaacttcacctgagaacttttgaactgaggaaagaacaacagagacttaaagggttaataaaaattgtaaagccagcagagattccagaactaaaaaagactgaaactcagactacaggtgcagaaaacaaagctaaaaagcttacattgcctctatttggtgccatgaaaggaggaagcaaattcaaattaaaaactggaacagtagggaagttaccccccaagcgtccagaactccctccaactctaatgagaatgaaagatgagcctgaagtagaagaggaggaggaagaggaagaggaagaagagaaagaaaaggaggagcatgaaaagaaaaaactggaggatggaagcctcagtaggccacagccagagatagagccagaagcagcagtgcaggaaatgaggcctcccacagatctcacacattttaaagaaacccaaacccatgaaaacatgtctcaacttagcgaggaagaacagaataaagattatcaagactgtagcaaaaccacttcattgtgcgcaggaccctcagcatcaaagaatgaatatgagaaaagcagaggtgaattgaagaaaaagaaaacacctggtccaggcaaacttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaatgtcctcacaaaaaaaagcacaaaaaaaaaatccaatctttaatataactcctctaataaacctcactctctccctcttgcgtttctttaaatgccccactcgtcttctttcatctatacgatttggctccttttcgcgatctcatgagaggctttcctttccccttcctttcttttaggggggatatatttctaaactctcctacaaaactacctcacatgtggcccgtccgttgccgttatcccttttccctcttctggggggtgttatagcgattacgtcacctcgggtcgtatgtctgtaactctcctttcacaacgctctttatttgctcctatcctattaacatgtctgcgctgctgattttatcccgtcct

SEQ ID NO: 298108 - DNA, 3403 bp, Homo sapiens
  misc_feature (697)..(697): n is a, c, g, or t
aggtctggacctgaaccgagacaaggaggtaccacactattcactgctgcgtcgcagagcgggctgggcggctgtctggacctcgagaggcctgaggcaaggatcgcgtcagaccccgaaagctggtttgttgattagtgatctaagaccgccggaagcgcttcttctcaatcaagctatgcaacaggaagtcattacgatcccgttgtaacctctaaatatgtccccgttctgcacagcatcccgataaccgttttgtttttctcatattatgaccttctcatgttagcaccacttcgcaacgctccaggtcgtgaaggagcaacttcaccatcgccgcctacagacgccactgggagcttgggagagtgggacgtggacaggaacgtaaagaccgaagggtgggtttcgaaggagcggatttcgaagttgcaccggttgaggatggctgacattctctctcagtcagagaccctggcgtcgcaagacctcagtggggacttcaagaagccagctctgccggtgtccccagcggcgcggagtaaggccccggccagcagttcttcaaaccctgaggaggtacagaaggaagggcccactgcgttgcaggactccaattctggggagcccgacatccctcctcctcagccggactgcggtgattttaggagtctacaggaggagcagtcgcgccccncgacagcggtttcttcccctggcggtccagcccgggctcccccctaccaagagcctccatggggtggccctgccacagccccctacagcttagagaccctgaagggcggcactatccttggcacccgtagcttgaaagggacgagttactgccttttcgggaggctgtctggctgcgacgtgtgcctggagcacccttcggtgtctcggtaccacgcagtgctgcagcacagggcgtccggccctgacggagaatgcgacagcaacgggccgggcttctacctctacgatctgggaagcacccatggcacttttctcaacaaaactcgcatcccacctcgcacctactgtcgagtccacgttgggcatgttgttcgctttggaggcagcacccggctctttatcctgcagggaccagaggaagaccgagaggcagaatccgagttaacagtaacacagttgaaggaattgcgcaagcagcagcaaatattgttggagaagaagatgctaggagaagactcagatgaagaagaggaaatggatacctctgaaaggaagataaatgctggtagccaagatgatgagatgggttgcacctggggaatgggagaagatgcagtagaggatgatgctgaagagaaccctattgtcttagagtttcagcaggaaagggaggccttttatataaaggatcccaaaaaggctctccaaggcttttttgaccgagaaggagaagaattagaatatgaatttgatgaacagggacatagcacttggctctgcagggtgagattacctgtggacgattcaactggaaaacaactggtggctgaggccattcactcaggaaagaaaaaagaagcaatgatccagtgctcattggaagcttgtcggattcttgacactttgggattgcttcggcaggaagcagtatctcggaaaaggaaagccaagaactgggaagatgaagacttttatgatagtgatgatgacacatttcttgataggactggcctgattgagaagaagcgtctgaacagaatgaagaaggctggcaagattgatgagaagccagagacctttgaatcattggttgcaaaattaaatgatgctgaaagggaactttctgaaatttctgagagattgaaagcctcaagccaagttctatcagagtctccatctcaggattctttagatgcgttcatgtcagaaatgaaatcaggcagtacattagatggtgtgtcccggaagaaacttcacctgagaacttttgaactgaggaaagaacaacagagacttaaagggttaataaaaattgtaaagccagcagagattccagaactaaaaaagactgaaactcagactacaggtgcagaaaacaaagctaaaaagcttacattgcctctatttggtgccatgaaaggaggaagcaaattcaaattaaaaactggaacagtagggaagttaccccccaagcgtccagaactccctccaactctaatgagaatgaaagatgagcctgaagtagaagaggaggaggaagaggaagaggaagaagagaaagaaaaggaggagcatgaaaagaaaaaactggaggatggaagcctcagtaggccacagccagagatagagccagaagcagcagtgcaggaaatgaggcctcccacagatctcacacattttaaagaaacccaaacccatgaaaacatgtctcaacttagcgaggaagaacagaataaagattatcaagactgtagcaaaaccacttcattgtgcgcaggaccctcagcatcaaagaatgaatatgagaaaagcagaggtgaattgaagaaaaagaaaacacctggtccaggcaaacttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaatgtcctaaatgttcctaatattttattttattttattttttttaagagacagggtcttactctgtcacctaggctggggtacagtggtgcaatcctagctcactgtagccttgaactcctgggctcaagcaatcctcccacctcagcctcccaagtacctgggactataggcatgtaccaccaccacacctggctaattattttatttaaattttttggagagatgaagtcttgccatgttgcccaggcttgtcttgaactcctggcctcaagtgatcctcctgcctcagcctcccaaagcactggaacctcatttttttttctttttttctgagacagggtctcactctgttgcccagagtgagtgcagtggcatgatcacagcttactgcagtggcatgatcacagcttactgcagtctcaacttcccaggctcaagtgatt

SEQ ID NO: 298109 - DNA, 3019 bp, Homo sapiens
  misc_feature (697)..(697): n is a, c, g, or t
  misc_feature (2984)..(2984): n is a, c, g, or t
aggtctggacctgaaccgagacaaggaggtaccacactattcactgctgcgtcgcagagcgggctgggcggctgtctggacctcgagaggcctgaggcaaggatcgcgtcagaccccgaaagctggtttgttgattagtgatctaagaccgccggaagcgcttcttctcaatcaagctatgcaacaggaagtcattacgatcccgttgtaacctctaaatatgtccccgttctgcacagcatcccgataaccgttttgtttttctcatattatgaccttctcatgttagcaccacttcgcaacgctccaggtcgtgaaggagcaacttcaccatcgccgcctacagacgccactgggagcttgggagagtgggacgtggacaggaacgtaaagaccgaagggtgggtttcgaaggagcggatttcgaagttgcaccggttgaggatggctgacattctctctcagtcagagaccctggcgtcgcaagacctcagtggggacttcaagaagccagctctgccggtgtccccagcggcgcggagtaaggccccggccagcagttcttcaaaccctgaggaggtacagaaggaagggcccactgcgttgcaggactccaattctggggagcccgacatccctcctcctcagccggactgcggtgattttaggagtctacaggaggagcagtcgcgccccncgacagcggtttcttcccctggcggtccagcccgggctcccccctaccaagagcctccatggggtggccctgccacagccccctacagcttagagaccctgaagggcggcactatccttggcacccgtagcttgaaagggacgagttactgccttttcgggaggctgtctggctgcgacgtgtgcctggagcacccttcggtgtctcggtaccacgcagtgctgcagcacagggcgtccggccctgacggagaatgcgacagcaacgggccgggcttctacctctacgatctgggaagcacccatggcacttttctcaacaaaactcgcatcccacctcgcacctactgtcgagtccacgttgggcatgttgttcgctttggaggcagcacccggctctttatcctgcagggaccagaggaagaccgagaggcagaatccgagttaacagtaacacagttgaaggaattgcgcaagcagcagcaaatattgttggagaagaagatgctaggagaagactcagatgaagaagaggaaatggatacctctgaaaggaagataaatgctggtagccaagatgatgagatgggttgcacctggggaatgggagaagatgcagtagaggatgatgctgaagagaaccctattgtcttagagtttcagcaggaaagggaggccttttatataaaggatcccaaaaaggctctccaaggcttttttgaccgagaaggagaagaattagaatatgaatttgatgaacagggacatagcacttggctctgcagggtgagattacctgtggacgattcaactggaaaacaactggtggctgaggccattcactcaggaaagaaaaaagaagcaatgatccagtgctcattggaagcttgtcggattcttgacactttgggattgcttcggcaggaagcagtatctcggaaaaggaaagccaagaactgggaagatgaagacttttatgatagtgatgatgacacatttcttgataggactggcctgattgagaagaagcgtctgaacagaatgaagaaggctggcaagattgatgagaagccagagacctttgaatcattggttgcaaaattaaatgatgctgaaagggaactttctgaaatttctgagagattgaaagcctcaagccaagttctatcagagtctccatctcaggattctttagatgcgttcatgtcagaaatgaaatcaggcagtacattagatggtgtgtcccggaagaaacttcacctgagaacttttgaactgaggaaagaacaacagagacttaaagggttaataaaaattgtaaagccagcagagattccagaactaaaaaagactgaaactcagactacaggtgcagaaaacaaagctaaaaagcttacattgcctctatttggtgccatgaaaggaggaagcaaattcaaattaaaaactggaacagtagggaagttaccccccaagcgtccagaactccctccaactctaatgagaatgaaagatgagcctgaagtagaagaggaggaggaagaggaagaggaagaagagaaagaaaaggaggagcatgaaaagaaaaaactggaggatggaagcctcagtaggccacagccagagatagagccagaagcagcagtgcaggaaatgaggcctcccacagatctcacacattttaaagaaacccaaacccatgaaaacatgtctcaacttagcgaggaagaacagaataaagattatcaagactgtagcaaaaccacttcattgtgcgcaggaccctcagcatcaaagaatgaatatgagaaaagcagaggtgaattgaagaaaaagaaaacacctggtccaggcaaacttccaccaacactttcttccaaatatcctgaagatgacccagactactgtgtgtgggtcccacctgaaggtcaaagtggagatggcagaacccatcttaatgacaagtatggctattgattgcttcagaatcccaaaagaaaaccttgtggaccatgtgacatggaatatttgggataatgtatcaaattgaatggccagagaagtttagatgattatttgtaagatctggtgactggcttttcgttctgtgttcttggcttcctaaatttatctgcccatatgattctcatgcatttgatatttatgtttaaaagtgtttatatatgtatgtaaaaagggaaccatatgttttgagaatttgtaaagtgagagacatgatcctattaaaataagaaggcaaaaatgtccttaaaacagtagcggcagcncccccccccctctttcatacgcaaaaaataattca

SEQ ID NO: 298110 - DNA, 604 bp, Homo sapiens
aactctatctctacaaaaaattaaaaaaaaaaaatattggccaggcatggtggtacatgcctgtagtcctagctactctgcaggctgaggcaggaggatctctgtagcccaggaattcaaggcagcagtgagctatgattgccccactgcactccagcttgggcaacagagaaaaaccctgtttctaaaataataataaattttggtggtcatctctgatttttaaaaaaatatgttctgggagtagaatttctaggccaaggagtatgtacatttttgaggcttttagtaagtattgctaaaaagttttacctcaatgttggctagtgttttaagtggaaaattggcagttttctgtaatacatttgaaacatatttatttaaaaccttaagattagttgaagctgatgataataaaactggatgattatgtacttagcttctctttctcttgtttttgtttttgtttgtttggctttccaccatgaattaaatcatgacaatatgatttgatattgctttttatagaaaacatgtctcaacttagcgaggaagaacagaataaagattatcaagactgtagcaaaaccacttcattgtgcgc

SEQ ID NO: 298111 - DNA, 765 bp, Homo sapiens
taagaagaaaggggaagcaggtggaaaagcaattaaaaaaaaatcagattctctttcggtgattcagagctgaaggtgcctcactgccctgtggaacaggtgaataaagccttcccagcatctctctctagcctattatctcctgttagacacagcccagaaaatgaatagagacaagtcctggctgggtctgggttcagaaacataatagaaggattcatctaaactgtcggccactgtggaggaagtgaaccttctagatcctgctgactcatacaatgagttttgtgtggaccatcagacaaaagggctggctggtgaaggtggctgttgtctggaaattcctcccagctctcctctaattatgtcataaggactggaggccccttagcctgcttgtgataacacgcaaggaaatatgggccaactcttcacatgaacacaagatatttccatgctagccttttgcaagtaacaacagagagagctctgtgcagttttcactggaatgcctgtggattgcttgtgtcataactgtaatctaaagagttgtccatttgttgattcctttgtatttgtattggtagaattgccactatcaaaccaagatctttagctgcctttgtatcaacttctttggagcttatgtgattttccagaaaatttccaaggcatagttttgtccctaagtcccatgaatatgtaatattttgtgtctctctattaaaatagcactttttgtgcattccattaacaaaaaaaaat

SEQ ID NO: 298112 - DNA, 694 bp, Homo sapiens
taagaagaaaggggaagcaggtggaaaagcaattaaaaaaaaatcagcatctctctctagcctattatctcctgttagacacagcccagaaaatgaatagagacaagtcctggctgggtctgggttcagaaacataatagaaggattcatctaaactgtcggccactgtggaggaagtgaaccttctagatcctgctgactcatacaatgagttttgtgtggaccatcagacaaaagggctggctggtgaaggtggctgttgtctggaaattcctcccagctctcctctaattatgtcataaggactggaggccccttagcctgcttgtgataacacgcaaggaaatatgggccaactcttcacatgaacacaagatatttccatgctagccttttgcaagtaacaacagagagagctctgtgcagttttcactggaatgcctgtggattgcttgtgtcataactgtaatctaaagagttgtccatttgttgattcctttgtatttgtattggtagaattgccactatcaaaccaagatctttagctgcctttgtatcaacttctttggagcttatgtgattttccagaaaatttccaaggcatagttttgtccctaagtcccatgaatatgtaatattttgtgtctctctattaaaatagcactttttgtgcattccattaacaaaaaaaaat

SEQ ID NO: 298113 - DNA, 458 bp, Homo sapiens
tactcaaccataagatgaatcatccataaaatgacccccacaaagctgtggtttacatgttcatcactcttttctgtcatttgttgctttcaggataacacgcaaggaaatatgggccaactcttcacatgaacacaagatatttccatgctagccttttgcaagtaacaacagagagagctctgtgcagttttcactggaatgcctgtggattgcttgtgtcataactgtaatctaaagagttgtccatttgttgattcctttgtatttgtattggtagaattgccactatcaaaccaagatctttagctgcctttgtatcaacttctttggagcttatgtgattttccagaaaatttccaaggcatagttttgtccctaagtcccatgaatatgtaatattttgtgtctctctattaaaatagcactttttgtgcattccattaacaaaaaaaaat

SEQ ID NO: 298114 - DNA, 856 bp, Homo sapiens
taagaagaaaggggaagcaggtggaaaagcaattaaaaaaaaatcagattctctttcggtgattcagagctgaaggtgcctcactgccctgtggaacaggtgaataaagccttcccagcatctctctctagcctattatctcctgttagacacagcccagaaaatgaatagagacaagtcctggctgggtctgggttcagaaacataatagaaggattcatctaaaggaagggaattctttccacagttgctagttcctcacacctctgcctctatgggattctcctggtccccacatgctctgctgtgtcttctagctgtcggccactgtggaggaagtgaaccttctagatcctgctgactcatacaatgagttttgtgtggaccatcagacaaaagggctggctggtgaaggtggctgttgtctggaaattcctcccagctctcctctaattatgtcataaggactggaggccccttagcctgcttgtgataacacgcaaggaaatatgggccaactcttcacatgaacacaagatatttccatgctagccttttgcaagtaacaacagagagagctctgtgcagttttcactggaatgcctgtggattgcttgtgtcataactgtaatctaaagagttgtccatttgttgattcctttgtatttgtattggtagaattgccactatcaaaccaagatctttagctgcctttgtatcaacttctttggagcttatgtgattttccagaaaatttccaaggcatagttttgtccctaagtcccatgaatatgtaatattttgtgtctctctattaaaatagcactttttgtgcattccattaacaaaaaaaaat

SEQ ID NO: 298115 - DNA, 5083 bp, Homo sapiens
agaagagcgatgggagggggtgacgtggcagtgacaggcgcataaactgaaatgaatggcggaaacagcagccaatcggcgatcagattggccgggcattccgcattctcccgtcctccctgagcgctggaaacttcaggaaagcaccaatgagcttccccaaaagtctgattggcctttatctgaaccaatcaaaggtgggtctggcggacgcgtcccaccccaggctctcactgggcgctgtagaatgacaggcccgagagaaatgccaatatccgcggggtcttcctcaagtgacactcagcggcaccaatcgacgtccttcttcccggcggccgagccctcctccccgcggctggccgggcggggcggggacgctgcgcggcggtggctgatgcggtagccgtgtggggcgctccgggcggcgacggcggctctcgtaggcggttccggtcttgtatctccaggcggcggcggctcatggcggcgacggagctgagaggagtggtggggccaggcccggcagccattgcagcacttggcggcggcggcgccggtcccccagtggtgggaggaggcggcggccgcggagatgcggggccaggctccggggccgcgtcagggacggtggtcgcggcggcggcgggaggcccgggcccgggggccgggggagtggcggcggctggcccggcccctgcgccgccgactgggggctcgggcggctcgggcgctgggggttcgggctcggctcgagagggctggctcttcaaatggaccaattatatcaaaggctaccagcggcgatggttcgtgctgagcaacgggctcctgagctactacagatcaaaggcagaaatgagacatacctgccgtggtaccatcaacctcgccacagccaacatcaccgtggaggactcctgcaacttcatcatttccaatgggggtgctcagacctaccatctgaaagctagttcagaagttgagcggcagcgctgggtgacggccctggaactggccaaggccaaagctgtgaagatgctggcagagtcagatgaatcaggagatgaagagtctgtctcacaaactgacaagactgagctgcagaatacccttcggaccctctctagcaaagtagaggacttgagcacgtgcaatgacttgatagctaagcatggcacagctctgcagcgttctctcagtgagctggagtccctgaagttgcctgctgagagcaatgaaaagatcaaacaggtcaacgaacgagccacactctttaggataacatccaatgccatgatcaacgcctgcagagatttcctcatgttagcccagacccatagtaaaaaatggcaaaagtcactacagtatgaaagagaccagcgtatccgactggaagaaaccctcgagcagctggcgaagcagcataatcacctggagagggccttccgaggagccacggtgctgccggcaaacactcctggcaatgtgggttctggtaaagatcagtgctgctctggcaaaggggacatgagcgatgaagatgatgagaatgaattttttgatgcacctgagatcatcaccatgcctgaaaatttgggccacaaacgtactggcagcaatatcagtggagccagcagtgacatcagccttgatgaacagtacaagcatcagctggaggagaccaaaaaggaaaagagaaccagaataccatacaagccaaactatagcctcaatttatggagcatcatgaagaactgcattggaaaagaactctctaagatccccatgccggtaaactttaatgagcccttgtccatgcttcagcgccttactgaagatctggaataccatgagctgttagaccgagctgcaaaatgtgagaattctctagaacagctctgttatgttgcagctttcaccgtgtcctcctactccactactgtcttccgcaccagtaagccattcaacccactgcttggggagacctttgagctggaccgattagaggagaatgggtaccgatccctctgtgaacaggtgagtcatcatccccctgctgctgcgcaccatgctgagtccaaaaatggctggacattgcgtcaggaaatcaaaatcaccagcaagtttcgaggcaaatacctctccattatgcccctcggtaccattcattgtattttccatgcaactgggcaccactacacttggaagaaagttaccacaactgtacacaacattattgtgggcaagttgtggatagatcagtctggcgaaattgatattgtgaatcacaagacaggagacaagtgtaatcttaaatttgttccttatagctacttctctcgggatgtagcaagaaaggtgacgggggaagtgacagatccatcaggaaaagtccactttgctcttctggggacgtgggatgagaaaatggaatgtttcaaagtacagccagtcattggggaaaatgggggtgatgctcgacagagaggccatgaagcagaggaaagcagggtcatgctgtggaaaaggaatcctttaccgaagaatgcagaaaacatgtactacttctcagagcttgctctgactctcaatgcttgggaaagtggcactgcccccacagacagccggttacgacctgaccagagactgatggaaaatggacgctgggatgaagcaaatgcggagaagcagcgcctggaggaaaaacaaagactttccagaaagaagagagaagcggaagctatgaaagccacagaggatggcacaccatatgatccctataaggcactgtggtttgagcggaagaaggaccctgttaccaaggagttaacccatatttataggggagaatactgggagtgtaaagaaaaacaggactggagctcatgcccggacattttctgaaacggcagtaacaaaaaagaggagcatataatggagaagaggacagaggatgtgtgggaaagctggaagttgtgactctcttaccaagtgctttcctcaagtttgtctctcttgaccaatcattttttccaaatcaatcaccagaaggagacaccagtggtggtgattggctggttgccttagctgattgaaactgaaatcgacataggagatactatgtctgtaagggagaggtttagtggccgaaggttagtgttattccacatccacgaagtcaagtattcttggctcttctttctccctctgcccccatttaagacaatgtcactcaccctccccttgtagtatcctgctcagccaagatctgcctaagattatgattcaggggcattttggtgctgttaaaagcaagagccgaatttagaagttcccttaaaaagaaacacataagacttaccaatggaggcattgtgaatggttgcagtggagcttaggtataacatcatcaagtgtgttcacacgcggggtcggtttaatggagtgtccacgcggagataactgcgatattggaacacctgtgagagagattgttctatagggctggaatattcagagttacattcttggaagtttctgtttttacttgcatcaaacacccctctgttgttctccatcatctttaatagcaactggagaccactttggtcattggtaagggggtgcattctcctcacaaaggggttttatggacttcctcaggcggagagcttctgagaacacaggcaggatggaaaaagactactagccacttttgctttcccaaccccccttaatgccatccttcattgtctttctggcttctcttcttctggcacagtaccattttgggtctgtgccccagtgtggagcaaaacattgcctgtcccattctgatatacttcagaatttgagagcagaagttaatgtggaacaaaagttttcaccatctctcaagccccaaggactggagccacctctggaataatgtgttaaatatctgtatattatatatatgtagagaaaaatctaattttttggtttgatttccttcccattaagaatcttgttttttgatacccttgtctccctgagactctttcttggacacgtgttgatgtggatggcactcctgctctccatcttttatgggcagagagatttcaaaacctgagcaggatcatgtctggcagttactaaacagggactttgtccatggtttgtatcatggggtgcctactgctgtctaaactctgctctcctaattagctgactcttgaaaatgaaatcctaacctctttcctgcctcttttctttctcttttcaggaagagtgtgggtagaaagtccggagggcaacttccaatttaattctgctctgtccggcgcataggctgaattccaaaagaactttcttcctaggatgtggggcttaaagcaccgtcatgtggggtggatcagataattgctcctgtggggccctggcttccttctctgtttgtgcagtatttgtttttgttgtcttgttgagaaatatcccctgtgcaacccacccttggttgaggatcacaaattgaggtgccttccttgtatgctttttgttagtattttttgtttttgttccttaactgctgagcctcagccagcgtgggtcctgggggaaataccattccaaaggaagccatccctatggggaaattggttttactgggtaaattaatacttttatttcttcccctatcccttccttcctagttgtgataaacatgggagaggagtgactttgactgctggggaatttcctcctaagaaccttattcccaaaataagccagggattatgtcaaggcttctttcaaggaggctcataaaagcagtgacctcatccggggctttggatagagtgagaattccccaactaaattggacttctctgctttatccccttctcttccttcaccatctgcactacatttctggctgatcccaatcagattcccgctaatggaagaagtttagaatctttcaggtggaataaagtcacatgaaaacaaaacacaactatatatattttcagtttttttgccttattgatttttttccaaaaaaaaaaaactactaaattaaataattttttaaaagtca

SEQ ID NO: 298116 - DNA, 5447 bp, Homo sapiens
agaagagcgatgggagggggtgacgtggcagtgacaggcgcataaactgaaatgaatggcggaaacagcagccaatcggcgatcagattggccgggcattccgcattctcccgtcctccctgagcgctggaaacttcaggaaagcaccaatgagcttccccaaaagtctgattggcctttatctgaaccaatcaaaggtgggtctggcggacgcgtcccaccccaggctctcactgggcgctgtagaatgacaggcccgagagaaatgccaatatccgcggggtcttcctcaagtgacactcagcggcaccaatcgacgtccttcttcccggcggccgagccctcctccccgcggctggccgggcggggcggggacgctgcgcggcggtggctgatgcggtagccgtgtggggcgctccgggcggcgacggcggctctcgtaggcggttccggtcttgtatctccaggcggcggcggctcatggcggcgacggagctgagaggagtggtggggccaggcccggcagccattgcagcacttggcggcggcggcgccggtcccccagtggtgggaggaggcggcggccgcggagatgcggggccaggctccggggccgcgtcagggacggtggtcgcggcggcggcgggaggcccgggcccgggggccgggggagtggcggcggctggcccggcccctgcgccgccgactgggggctcgggcggctcgggcgctgggggttcgggctcggctcgagagggctggctcttcaaatggaccaattatatcaaaggctaccagcggcgatggttcgtgctgagcaacgggctcctgagctactacagatcaaaggcagaaatgagacatacctgccgtggtaccatcaacctcgccacagccaacatcaccgtggaggactcctgcaacttcatcatttccaatgggggtgctcagacctaccatctgaaagctagttcagaagttgagcggcagcgctgggtgacggccctggaactggccaaggccaaagctgtgaagatgctggcagagtcagatgaatcaggagatgaagagtctgtctcacaaactgacaagactgagctgcagaatacccttcggaccctctctagcaaagtagaggacttgagcacgtgcaatgacttgatagctaagcatggcacagctctgcagcgttctctcagtgagctggagtccctgaagttgcctgctgagagcaatgaaaagatcaaacaggtcaacgaacgagccacactctttaggataacatccaatgccatgatcaacgcctgcagagatttcctcatgttagcccagacccatagtaaaaaatggcaaaagtcactacagtatgaaagagaccagcgtatccgactggaagaaaccctcgagcagctggcgaagcagcataatcacctggagagggccttccgaggagccacggtgctgccggcaaacactcctggcaatgtgggttctggtaaagatcagtgctgctctggcaaaggggacatgagcgatgaagatgatgagaatgaattttttgatgcacctgagatcatcaccatgcctgaaaatttgggccacaaacgtactggcagcaatatcagtggagccagcagtgacatcagccttgatgaacagtacaagcatcagctggaggagaccaaaaaggaaaagagaaccagaataccatacaagccaaactatagcctcaatttatggagcatcatgaagaactgcattggaaaagaactctctaagatccccatgccggtaaactttaatgagcccttgtccatgcttcagcgccttactgaagatctggaataccatgagctgttagaccgagctgcaaaatgtgagaattctctagaacagctctgttatgttgcagctttcaccgtgtcctcctactccactactgtcttccgcaccagtaagccattcaacccactgcttggggagacctttgagctggaccgattagaggagaatgggtaccgatccctctgtgaacaggtgagtcatcatccccctgctgctgcgcaccatgctgagtccaaaaatggctggacattgcgtcaggaaatcaaaatcaccagcaagtttcgaggcaaatacctctccattatgcccctcggtaccattcattgtattttccatgcaactgggcaccactacacttggaagaaagttaccacaactgtacacaacattattgtgggcaagttgtggatagatcagtctggcgaaattgatattgtgaatcacaagacaggagacaagtgtaatcttaaatttgttccttatagctacttctctcgggatgtagcaagaaaggtgacgggggaagtgacagatccatcaggaaaagtccactttgctcttctggggacgtgggatgagaaaatggaatgtttcaaagtacagccagtcattggggaaaatgggggtgatgctcgacagagaggccatgaagcagaggaaagcagggtcatgctgtggaaaaggaatcctttaccgaagaatgcagaaaacatgtactacttctcagagcttgctctgactctcaatgcttgggaaagtggcactgcccccacagacagccggttacgacctgaccagagactgatggaaaatggacgctgggatgaagcaaatgcggagaagcagcgcctggaggaaaaacaaagactttccagaaagaagagagaagcggaagctatgaaagccacagaggatggcacaccatatgatccctataaggcactgtggtttgagcggaagaaggaccctgttaccaaggagttaacccatatttataggggagaatactgggagtgtaaagaaaaacaggactggagctcatgcccggacattttctgaaacggcagtaacaaaaaagaggagcatataatggagaagaggacagaggatgtgtgggaaagctggaagttgtgactctcttaccaagtgctttcctcaagtttgtctctcttgaccaatcattttttccaaatcaatcaccagaaggagacaccagtggtggtgattggctggttgccttagctgattgaaactgaaatcgacataggagatactatgtctgtaagggagaggtttagtggccgaaggttagtgttattccacatccacgaagtcaagtattcttggctcttctttctccctctgcccccatttaagacaatgtcactcaccctccccttgtagtatcctgctcagccaagatctgcctaagattatgattcaggggcattttggtgctgttaaaagcaagagccgaatttagaagttcccttaaaaagaaacacataagacttaccaatggaggcattgtgaatggttgcagtggagcttaggtataacatcatcaagtgtgttcacacgcggggtcggtttaatggagtgtccacgcggagataactgcgatattggaacacctgtgagagagattgttctatagggctggaatattcagagttacattcttggaagtttctgtttttacttgcatcaaacacccctctgttgttctccatcatctttaatagcaactggagaccactttggtcattggtaagggggtgcattctcctcacaaaggggttttatggacttcctcaggcggagagcttctgagaacacaggcaggatggaaaaagactactagccacttttgctttcccaaccccccttaatgccatccttcattgtctttctggcttctcttcttctggcacagtaccattttgggtctgtgccccagtgtggagcaaaacattgcctgtcccattctgatatacttcagaatttgagagcagaagttaatgtggaacaaaagttttcaccatctctcaagccccaaggactggagccacctctggaataatgtgttaaatatctgtatattatatatatgtagagaaaaatctaattttttggtttgatttccttcccattaagaatcttgttttttgatacccttgtctccctgagactctttcttggacacgtgttgatgtggatggcactcctgctctccatcttttatgggcagagagatttcaaaacctgagcaggatcatgtctggcagttactaaacagggactttgtccatggtttgtatcatggggtgcctactgctgtctaaactctgctctcctaattagctgactcttgaaaatgaaatcctaacctctttcctgcctcttttctttctcttttcaggaagagtgtgggtagaaagtccggagggcaacttccaatttaattctgctctgtccggcgcataggctgaattccaaaagaactttcttcctaggatgtggggcttaaagcaccgtcatgtggggtggatcagataattgctcctgtggggccctggcttccttctctgtttgtgcagtatttgtttttgttgtcttgttgagaaatatcccctgtgcaacccacccttggttgaggatcacaaattgaggtgccttccttgtatgctttttgttagtattttttgtttttgttccttaactgctgagcctcagccagcgtgggtcctgggggaaataccattccaaaggaagccatccctatggggaaattggttttactgggtaaattaatacttttatttcttcccctatcccttccttcctagttgtgataaacatgggagaggagtgactttgactgctggggaatttcctcctaagaaccttattcccaaaataagccagggattatgtcaaggcttctttcaaggaggctcataaaagcagtgacctcatccggggctttggatagagtgagaattccccaactaaattggacttctctgctttatccccttctcttccttcaccatctgcactacatttctggctgatcccaatcagattcccgctaatggaagaagtttagaatctttcaggtggaataaagtcacatgaaaacaaaacacaactatatatattttcagtttttttgccttattgatttttttccaaaaaaaaaaaactactaaattaaataattttttaaaagtcaaaaaaaaaaaaacaaaaaaaaaaaacaaaaacaatgtgtggtggggcgacgcctcgggagccctagaaaaaaggctttctaaacaccaacagtctccggtggggcgccccggggcccacgatcgatgtccacgagaacaacggggcaacagtgggtgttctccctgaagaaaatcccggcggcccatgagaacagcggtgtgcggcgattctccccacagataaaaacaagcccccggggcgtaaccccaagccgggtgtaggaacaacactaccagaaagggggcgctgagagggccacctaacgcgagcctcatccgacgggagacccaagacacgccctgaattaaatatacgcagccagg

SEQ ID NO: 298117 - DNA, 5169 bp, Homo sapiens
  misc_feature (5087)..(5087): n is a, c, g, or t
agaagagcgatgggagggggtgacgtggcagtgacaggcgcataaactgaaatgaatggcggaaacagcagccaatcggcgatcagattggccgggcattccgcattctcccgtcctccctgagcgctggaaacttcaggaaagcaccaatgagcttccccaaaagtctgattggcctttatctgaaccaatcaaaggtgggtctggcggacgcgtcccaccccaggctctcactgggcgctgtagaatgacaggcccgagagaaatgccaatatccgcggggtcttcctcaagtgacactcagcggcaccaatcgacgtccttcttcccggcggccgagccctcctccccgcggctggccgggcggggcggggacgctgcgcggcggtggctgatgcggtagccgtgtggggcgctccgggcggcgacggcggctctcgtaggcggttccggtcttgtatctccaggcggcggcggctcatggcggcgacggagctgagaggagtggtggggccaggcccggcagccattgcagcacttggcggcggcggcgccggtcccccagtggtgggaggaggcggcggccgcggagatgcggggccaggctccggggccgcgtcagggacggtggtcgcggcggcggcgggaggcccgggcccgggggccgggggagtggcggcggctggcccggcccctgcgccgccgactgggggctcgggcggctcgggcgctgggggttcgggctcggctcgagagggctggctcttcaaatggaccaattatatcaaaggctaccagcggcgatggttcgtgctgagcaacgggctcctgagctactacagatcaaaggcagaaatgagacatacctgccgtggtaccatcaacctcgccacagccaacatcaccgtggaggactcctgcaacttcatcatttccaatgggggtgctcagacctaccatctgaaagctagttcagaagttgagcggcagcgctgggtgacggccctggaactggccaaggccaaagctgtgaagatgctggcagagtcagatgaatcaggagatgaagagtctgtctcacaaactgacaagactgagctgcagaatacccttcggaccctctctagcaaagtagaggacttgagcacgtgcaatgacttgatagctaagcatggcacagctctgcagcgttctctcagtgagctggagtccctgaagttgcctgctgagagcaatgaaaagatcaaacaggtcaacgaacgagccacactctttaggataacatccaatgccatgatcaacgcctgcagagatttcctcatgttagcccagacccatagtaaaaaatggcaaaagtcactacagtatgaaagagaccagcgtatccgactggaagaaaccctcgagcagctggcgaagcagcataatcacctggagagggccttccgaggagccacggtgctgccggcaaacactcctggcaatgtgggttctggtaaagatcagtgctgctctggcaaaggggacatgagcgatgaagatgatgagaatgaattttttgatgcacctgagatcatcaccatgcctgaaaatttgggccacaaacgtactggcagcaatatcagtggagccagcagtgacatcagccttgatgaacagtacaagcatcagctggaggagaccaaaaaggaaaagagaaccagaataccatacaagccaaactatagcctcaatttatggagcatcatgaagaactgcattggaaaagaactctctaagatccccatgccggtaaactttaatgagcccttgtccatgcttcagcgccttactgaagatctggaataccatgagctgttagaccgagctgcaaaatgtgagaattctctagaacagctctgttatgttgcagctttcaccgtgtcctcctactccactactgtcttccgcaccagtaagccattcaacccactgcttggggagacctttgagctggaccgattagaggagaatgggtaccgatccctctgtgaacaggtgagtcatcatccccctgctgctgcgcaccatgctgagtccaaaaatggctggacattgcgtcaggaaatcaaaatcaccagcaagtttcgaggcaaatacctctccattatgcccctcggtaccattcattgtattttccatgcaactgggcaccactacacttggaagaaagttaccacaactgtacacaacattattgtgggcaagttgtggatagatcagtctggcgaaattgatattgtgaatcacaagacaggagacaagtgtaatcttaaatttgttccttatagctacttctctcgggatgtagcaagaaaggtgacgggggaagtgacagatccatcaggaaaagtccactttgctcttctggggacgtgggatgagaaaatggaatgtttcaaagtacagccagtcattggggaaaatgggggtgatgctcgacagagaggccatgaagcagaggaaagcagggtcatgctgtggaaaaggaatcctttaccgaagaatgcagaaaacatgtactacttctcagagcttgctctgactctcaatgcttgggaaagtggcactgcccccacagacagccggttacgacctgaccagagactgatggaaaatggacgctgggatgaagcaaatgcggagaagcagcgcctggaggaaaaacaaagactttccagaaagaagagagaagcggaagctatgaaagccacagaggatggcacaccatatgatccctataaggcactgtggtttgagcggaagaaggaccctgttaccaaggagttaacccatatttataggggagaatactgggagtgtaaagaaaaacaggactggagctcatgcccggacattttctgaaacggcagtaacaaaaaagaggagcatataatggagaagaggacagaggatgtgtgggaaagctggaagttgtgactctcttaccaagtgctttcctcaagtttgtctctcttgaccaatcattttttccaaatcaatcaccagaaggagacaccagtggtggtgattggctggttgccttagctgattgaaactgaaatcgacataggagatactatgtctgtaagggagaggtttagtggccgaaggttagtgttattccacatccacgaagtcaagtattcttggctcttctttctccctctgcccccatttaagacaatgtcactcaccctccccttgtagtatcctgctcagccaagatctgcctaagattatgattcaggggcattttggtgctgttaaaagcaagagccgaatttagaagttcccttaaaaagaaacacataagacttaccaatggaggcattgtgaatggttgcagtggagcttaggtataacatcatcaagtgtgttcacacgcggggtcggtttaatggagtgtccacgcggagataactgcgatattggaacacctgtgagagagattgttctatagggctggaatattcagagttacattcttggaagtttctgtttttacttgcatcaaacacccctctgttgttctccatcatctttaatagcaactggagaccactttggtcattggtaagggggtgcattctcctcacaaaggggttttatggacttcctcaggcggagagcttctgagaacacaggcaggatggaaaaagactactagccacttttgctttcccaaccccccttaatgccatccttcattgtctttctggcttctcttcttctggcacagtaccattttgggtctgtgccccagtgtggagcaaaacattgcctgtcccattctgatatacttcagaatttgagagcagaagttaatgtggaacaaaagttttcaccatctctcaagccccaaggactggagccacctctggaataatgtgttaaatatctgtatattatatatatgtagagaaaaatctaattttttggtttgatttccttcccattaagaatcttgttttttgatacccttgtctccctgagactctttcttggacacgtgttgatgtggatggcactcctgctctccatcttttatgggcagagagatttcaaaacctgagcaggatcatgtctggcagttactaaacagggactttgtccatggtttgtatcatggggtgcctactgctgtctaaactctgctctcctaattagctgactcttgaaaatgaaatcctaacctctttcctgcctcttttctttctcttttcaggaagagtgtgggtagaaagtccggagggcaacttccaatttaattctgctctgtccggcgcataggctgaattccaaaagaactttcttcctaggatgtggggcttaaagcaccgtcatgtggggtggatcagataattgctcctgtggggccctggcttccttctctgtttgtgcagtatttgtttttgttgtcttgttgagaaatatcccctgtgcaacccacccttggttgaggatcacaaattgaggtgccttccttgtatgctttttgttagtattttttgtttttgttccttaactgctgagcctcagccagcgtgggtcctgggggaaataccattccaaaggaagccatccctatggggaaattggttttactgggtaaattaatacttttatttcttcccctatcccttccttcctagttgtgataaacatgggagaggagtgactttgactgctggggaatttcctcctaagaaccttattcccaaaataagccagggattatgtcaaggcttctttcaaggaggctcataaaagcagtgacctcatccggggctttggatagagtgagaattccccaactaaattggacttctctgctttatccccttctcttccttcaccatctgcactacatttctggctgatcccaatcagattcccgctaatggaagaagtttagaatctttcaggtggaataaagtcacatgaaaacaaaacacaactatatatattttcagtttttttgccttattgatttttttccaaaaaaaaaaaactactaaattaaataattttttaaaagtcaaaanaaaaatttcccccgtggaatttctatccttttaatcaaatattcctgtaattctttttccaatttaagggttttaaaaaaaa

SEQ ID NO: 298118 - DNA, 4988 bp, Homo sapiens
agaagagcgatgggagggggtgacgtggcagtgacaggcgcataaactgaaatgaatggcggaaacagcagccaatcggcgatcagattggccgggcattccgcattctcccgtcctccctgagcgctggaaacttcaggaaagcaccaatgagcttccccaaaagtctgattggcctttatctgaaccaatcaaaggtgggtctggcggacgcgtcccaccccaggctctcactgggcgctgtagaatgacaggcccgagagaaatgccaatatccgcggggtcttcctcaagtgacactcagcggcaccaatcgacgtccttcttcccggcggccgagccctcctccccgcggctggccgggcggggcggggacgctgcgcggcggtggctgatgcggtagccgtgtggggcgctccgggcggcgacggcggctctcgtaggcggttccggtcttgtatctccaggcggcggcggctcatggcggcgacggagctgagaggagtggtggggccaggcccggcagccattgcagcacttggcggcggcggcgccggtcccccagtggtgggaggaggcggcggccgcggagatgcggggccaggctccggggccgcgtcagggacggtggtcgcggcggcggcgggaggcccgggcccgggggccgggggagtggcggcggctggcccggcccctgcgccgccgactgggggctcgggcggctcgggcgctgggggttcgggctcggctcgagagggctggctcttcaaatggaccaattatatcaaaggctaccagcggcgatggttcgtgctgagcaacgggctcctgagctactacagatcaaaggcagaaatgagacatacctgccgtggtaccatcaacctcgccacagccaacatcaccgtggaggactcctgcaacttcatcatttccaatgggggtgctcagacctaccatctgaaagctagttcagaagttgagcggcagcgctgggtgacggccctggaactggccaaggccaaagctgtgaagatgctggcagagtcagatgaatcaggagatgaagagtctgtctcacaaactgacaagactgagctgcagaatacccttcggaccctctctagcaaagtagaggacttgagcacgtgcaatgacttgatagctaagcatggcacagctctgcagcgttctctcagtgagctggagtccctgaagttgcctgctgagagcaatgaaaagatcaaacaggtcaacgaacgagccacactctttaggataacatccaatgccatgatcaacgcctgcagagatttcctcatgttagcccagacccatagtaaaaaatggcaaaagtcactacagtatgaaagagaccagcgtatccgactggaagaaaccctcgagcagctggcgaagcagcataatcacctggagagggccttccgaggagccacggtgctgccggcaaacactcctggcaatgtgggttctggtaaagatcagtgctgctctggcaaaggggacatgagcgatgaagatgatgagaatgaattttttgatgcacctgagatcatcaccatgcctgaaaatttgggccacaaacgtactggcagcaatatcagtggagccagcagtgacatcagccttgatgaacagtacaagcatcagctggaggagaccaaaaaggaaaagagaaccagaataccatacaagccaaactatagcctcaatttatggagcatcatgaagaactgcattggaaaagaactctctaagatccccatgccggtaaactttaatgagcccttgtccatgcttcagcgccttactgaagatctggaataccatgagctgttagaccgagctgcaaaatgtgagaattctctagaacagctctgttatgttgcagctttcaccgtgtcctcctactccactactgtcttccgcaccagtaagccattcaacccactgcttggggagacctttgagctggaccgattagaggagaatgggtaccgatccctctgtgaacaggtgagtcatcatccccctgctgctgcgcaccatgctgagtccaaaaatggctggacattgcgtcaggaaatcaaaatcaccagcaagtttcgaggcaaatacctctccattatgcccctcggtaccattcattgtattttccatgcaactgggcaccactacacttggaagaaagttaccacaactgtacacaacattattgtgggcaagttgtggatagatcagtctggcgaaattgatattgtgaatcacaagacaggagacaagtgtaatcttaaatttgttccttatagctacttctctcgggatgtagcaagaaaggtgacgggggaagtgacagatccatcaggaaaagtccactttgctcttctggggacgtgggatgagaaaatggaatgtttcaaagtacagccagtcattggggaaaatgggggtgatgctcgacagagaggccatgaagcagaggaaagcagggtcatgctgtggaaaaggaatcctttaccgaagaatgcagaaaacatgtactacttctcagagcttgctctgactctcaatgcttgggaaagtggcactgcccccacagacagccggttacgacctgaccagagactgatggaaaatggacgctgggatgaagcaaatgcggagaagcagcgcctggaggaaaaacaaagactttccagaaagaagagagaagcggaagctatgaaagccacagaggatggcacaccatatgatccctataaggcactgtggtttgagcggaagaaggaccctgttaccaaggagttaacccatatttataggggagaatactgggagtgtaaagaaaaacaggactggagctcatgcccggacattttctgaaacggcagtaacaaaaaagaggagcatataatggagaagaggacagaggatgtgtgggaaagctggaagttgtgactctcttaccaagtgctttcctcaagtttgtctctcttgaccaatcattttttccaaatcaatcaccagaaggagacaccagtggtggtgattggctggttgccttagctgattgaaactgaaatcgacataggagatactatgtctgtaagggagaggtttagtggccgaaggttagtgttattccacatccacgaagtcaagtattcttggctcttctttctccctctgcccccatttaagacaatgtcactcaccctccccttgtagtatcctgctcagccaagatctgcctaagattatgattcaggggcattttggtgctgttaaaagcaagagccgaatttagaagttcccttaaaaagaaacacataagacttaccaatggaggcattgtgaatggttgcagtggagcttaggtataacatcatcaagtgtgttcacacgcggggtcggtttaatggagtgtccacgcggagataactgcgatattggaacacctgtgagagagattgttctatagggctggaatattcagagttacattcttggaagtttctgtttttacttgcatcaaacacccctctgttgttctccatcatctttaatagcaactggagaccactttggtcattggtaagggggtgcattctcctcacaaaggggttttatggacttcctcaggcggagagcttctgagaacacaggcaggatggaaaaagactactagccacttttgctttcccaaccccccttaatgccatccttcattgtctttctggcttctcttcttctggcacagtaccattttgggtctgtgccccagtgtggagcaaaacattgcctgtcccattctgatatacttcagaatttgagagcagaagttaatgtggaacaaaagttttcaccatctctcaagccccaaggactggagccacctctggaataatgtgttaaatatctgtatattatatatatgtagagaaaaatctaattttttggtttgatttccttcccattaagaatcttgttttttgatacccttgtctccctgagactctttcttggacacgtgttgatgtggatggcactcctgctctccatcttttatgggcagagagatttcaaaacctgagcaggatcatgtctggcagttactaaacagggactttgtccatggtttgtatcatggggtgcctactgctgtctaaactctgctctcctaattagctgactcttgaaaatgaaatcctaacctctttcctgcctcttttctttctcttttcaggaagagtgtgggtagaaagtccggagggcaacttccaatttaattctgctctgtccggcgcataggctgaattccaaaagaactttcttcctaggatgtggggcttaaagcaccgtcatgtggggtggatcagataattgctcctgtggggccctggcttccttctctgtttgtgcagtatttgtttttgttgtcttgttgagaaatatcccctgtgcaacccacccttggttgaggatcacaaattgaggtgccttccttgtatgctttttgttagtattttttgtttttgttccttaactgctgagcctcagccagcgtgggtcctgggggaaataccattccaaaggaagccatccctatggggaaattggttttactgggtaaattaatacttttatttcttcccctatcccttccttcctagttgtgataaacatgggagaggagtgactttgactgctggggaatttcctcctaagaaccttattcccaaaataagccagggattatgtcaaggcttctttcaaggaggctcataaaagcagtgacctcatccggggctttggatagagtgagaattccccaactaaattggacttctctgctttatccccttctcttccttcaccatctgcactacatttctggctgatcccaatcagattcccgctaatggaagaagtttagaatctttcaggtggaataaagtcacatgaaa

SEQ ID NO: 298119 - DNA, 5368 bp, Homo sapiens
agaagagcgatgggagggggtgacgtggcagtgacaggcgcataaactgaaatgaatggcggaaacagcagccaatcggcgatcagattggccgggcattccgcattctcccgtcctccctgagcgctggaaacttcaggaaagcaccaatgagcttccccaaaagtctgattggcctttatctgaaccaatcaaaggtgggtctggcggacgcgtcccaccccaggctctcactgggcgctgtagaatgacaggcccgagagaaatgccaatatccgcggggtcttcctcaagtgacactcagcggcaccaatcgacgtccttcttcccggcggccgagccctcctccccgcggctggccgggcggggcggggacgctgcgcggcggtggctgatgcggtagccgtgtggggcgctccgggcggcgacggcggctctcgtaggcggttccggtcttgtatctccaggcggcggcggctcatggcggcgacggagctgagaggagtggtggggccaggcccggcagccattgcagcacttggcggcggcggcgccggtcccccagtggtgggaggaggcggcggccgcggagatgcggggccaggctccggggccgcgtcagggacggtggtcgcggcggcggcgggaggcccgggcccgggggccgggggagtggcggcggctggcccggcccctgcgccgccgactgggggctcgggcggctcgggcgctgggggttcgggctcggctcgagagggctggctcttcaaatggaccaattatatcaaaggctaccagcggcgatggttcgtgctgagcaacgggctcctgagctactacagatcaaaggcagaaatgagacatacctgccgtggtaccatcaacctcgccacagccaacatcaccgtggaggactcctgcaacttcatcatttccaatgggggtgctcagacctaccatctgaaagctagttcagaagttgagcggcagcgctgggtgacggccctggaactggccaaggccaaagctgtgaagatgctggcagagtcagatgaatcaggagatgaagagtctgtctcacaaactgacaagactgagctgcagaatacccttcggaccctctctagcaaagtagaggacttgagcacgtgcaatgacttgatagctaagcatggcacagctctgcagcgttctctcagtgagctggagtccctgaagttgcctgctgagagcaatgaaaagatcaaacaggtcaacgaacgagccacactctttaggataacatccaatgccatgatcaacgcctgcagagatttcctcatgttagcccagacccatagtaaaaaatggcaaaagtcactacagtatgaaagagaccagcgtatccgactggaagaaaccctcgagcagctggcgaagcagcataatcacctggagagggccttccgaggagccacggtgctgccggcaaacactcctggcaatgtgggttctggtaaagatcagtgctgctctggcaaaggggacatgagcgatgaagatgatgagaatgaattttttgatgcacctgagatcatcaccatgcctgaaaatttgggccacaaacgtactggcagcaatatcagtggagccagcagtgacatcagccttgatgaacagtacaagcatcagctggaggagaccaaaaaggaaaagagaaccagaataccatacaagccaaactatagcctcaatttatggagcatcatgaagaactgcattggaaaagaactctctaagatccccatgccggtaaactttaatgagcccttgtccatgcttcagcgccttactgaagatctggaataccatgagctgttagaccgagctgcaaaatgtgagaattctctagaacagctctgttatgttgcagctttcaccgtgtcctcctactccactactgtcttccgcaccagtaagccattcaacccactgcttggggagacctttgagctggaccgattagaggagaatgggtaccgatccctctgtgaacaggtaaaggaacctcagaaccataacgcatttcctttctgaagaaagagatgattttttggttaatcccctgggtcttatgtttgcagaaattctagtccctgtcatcccagcttttattctttttcttcagaacgtcagcgttggagaccctggaggttctgggattcacctactgttgtgggtgtaaaaacgtcaagtgtgaattttggtgtttctcaccaatttataggcagtatctttttcttctcctttctgccgtcttaatttgaacctgatttcttcaaggtgagtcatcatccccctgctgctgcgcaccatgctgagtccaaaaatggctggacattgcgtcaggaaatcaaaatcaccagcaagtttcgaggcaaatacctctccattatgcccctcggtaccattcattgtattttccatgcaactgggcaccactacacttggaagaaagttaccacaactgtacacaacattattgtgggcaagttgtggatagatcagtctggcgaaattgatattgtgaatcacaagacaggagacaagtgtaatcttaaatttgttccttatagctacttctctcgggatgtagcaagaaaggtgacgggggaagtgacagatccatcaggaaaagtccactttgctcttctggggacgtgggatgagaaaatggaatgtttcaaagtacagccagtcattggggaaaatgggggtgatgctcgacagagaggccatgaagcagaggaaagcagggtcatgctgtggaaaaggaatcctttaccgaagaatgcagaaaacatgtactacttctcagagcttgctctgactctcaatgcttgggaaagtggcactgcccccacagacagccggttacgacctgaccagagactgatggaaaatggacgctgggatgaagcaaatgcggagaagcagcgcctggaggaaaaacaaagactttccagaaagaagagagaagcggaagctatgaaagccacagaggatggcacaccatatgatccctataaggcactgtggtttgagcggaagaaggaccctgttaccaaggagttaacccatatttataggggagaatactgggagtgtaaagaaaaacaggactggagctcatgcccggacattttctgaaacggcagtaacaaaaaagaggagcatataatggagaagaggacagaggatgtgtgggaaagctggaagttgtgactctcttaccaagtgctttcctcaagtttgtctctcttgaccaatcattttttccaaatcaatcaccagaaggagacaccagtggtggtgattggctggttgccttagctgattgaaactgaaatcgacataggagatactatgtctgtaagggagaggtttagtggccgaaggttagtgttattccacatccacgaagtcaagtattcttggctcttctttctccctctgcccccatttaagacaatgtcactcaccctccccttgtagtatcctgctcagccaagatctgcctaagattatgattcaggggcattttggtgctgttaaaagcaagagccgaatttagaagttcccttaaaaagaaacacataagacttaccaatggaggcattgtgaatggttgcagtggagcttaggtataacatcatcaagtgtgttcacacgcggggtcggtttaatggagtgtccacgcggagataactgcgatattggaacacctgtgagagagattgttctatagggctggaatattcagagttacattcttggaagtttctgtttttacttgcatcaaacacccctctgttgttctccatcatctttaatagcaactggagaccactttggtcattggtaagggggtgcattctcctcacaaaggggttttatggacttcctcaggcggagagcttctgagaacacaggcaggatggaaaaagactactagccacttttgctttcccaaccccccttaatgccatccttcattgtctttctggcttctcttcttctggcacagtaccattttgggtctgtgccccagtgtggagcaaaacattgcctgtcccattctgatatacttcagaatttgagagcagaagttaatgtggaacaaaagttttcaccatctctcaagccccaaggactggagccacctctggaataatgtgttaaatatctgtatattatatatatgtagagaaaaatctaattttttggtttgatttccttcccattaagaatcttgttttttgatacccttgtctccctgagactctttcttggacacgtgttgatgtggatggcactcctgctctccatcttttatgggcagagagatttcaaaacctgagcaggatcatgtctggcagttactaaacagggactttgtccatggtttgtatcatggggtgcctactgctgtctaaactctgctctcctaattagctgactcttgaaaatgaaatcctaacctctttcctgcctcttttctttctcttttcaggaagagtgtgggtagaaagtccggagggcaacttccaatttaattctgctctgtccggcgcataggctgaattccaaaagaactttcttcctaggatgtggggcttaaagcaccgtcatgtggggtggatcagataattgctcctgtggggccctggcttccttctctgtttgtgcagtatttgtttttgttgtcttgttgagaaatatcccctgtgcaacccacccttggttgaggatcacaaattgaggtgccttccttgtatgctttttgttagtattttttgtttttgttccttaactgctgagcctcagccagcgtgggtcctgggggaaataccattccaaaggaagccatccctatggggaaattggttttactgggtaaattaatacttttatttcttcccctatcccttccttcctagttgtgataaacatgggagaggagtgactttgactgctggggaatttcctcctaagaaccttattcccaaaataagccagggattatgtcaaggcttctttcaaggaggctcataaaagcagtgacctcatccggggctttggatagagtgagaattccccaactaaattggacttctctgctttatccccttctcttccttcaccatctgcactacatttctggctgatcccaatcagattcccgctaatggaagaagtttagaatctttcaggtggaataaagtcacatgaaaacaaaacacaactatatatattttcagtttttttgccttattgatttttttccaaaaaaaaaaaactactaaattaaataattttttaaaagtca

SEQ ID NO: 298120 - DNA, 3761 bp, Homo sapiens
ctagtcagcccccgcgttaatcggcaccgaggaaagcctacagtatgaaagagaccagcgtatccgactggaagaaaccctcgagcagctggcgaagcagcataatcacctggagagggccttccgaggagccacggtgctgccggcaaacactcctggcaatgtgggttctggtaaagatcagtgctgctctggcaaaggggacatgagcgatgaagatgatgagaatgaattttttgatgcacctgagatcatcaccatgcctgaaaatttgggccacaaacgtactggcagcaatatcagtggagccagcagtgacatcagccttgatgaacagtacaagcatcagctggaggagaccaaaaaggaaaagagaaccagaataccatacaagccaaactatagcctcaatttatggagcatcatgaagaactgcattggaaaagaactctctaagatccccatgccggtaaactttaatgagcccttgtccatgcttcagcgccttactgaagatctggaataccatgagctgttagaccgagctgcaaaatgtgagaattctctagaacagctctgttatgttgcagctttcaccgtgtcctcctactccactactgtcttccgcaccagtaagccattcaacccactgcttggggagacctttgagctggaccgattagaggagaatgggtaccgatccctctgtgaacaggtgagtcatcatccccctgctgctgcgcaccatgctgagtccaaaaatggctggacattgcgtcaggaaatcaaaatcaccagcaagtttcgaggcaaatacctctccattatgcccctcggtaccattcattgtattttccatgcaactgggcaccactacacttggaagaaagttaccacaactgtacacaacattattgtgggcaagttgtggatagatcagtctggcgaaattgatattgtgaatcacaagacaggagacaagtgtaatcttaaatttgttccttatagctacttctctcgggatgtagcaagaaaggtgacgggggaagtgacagatccatcaggaaaagtccactttgctcttctggggacgtgggatgagaaaatggaatgtttcaaagtacagccagtcattggggaaaatgggggtgatgctcgacagagaggccatgaagcagaggaaagcagggtcatgctgtggaaaaggaatcctttaccgaagaatgcagaaaacatgtactacttctcagagcttgctctgactctcaatgcttgggaaagtggcactgcccccacagacagccggttacgacctgaccagagactgatggaaaatggacgctgggatgaagcaaatgcggagaagcagcgcctggaggaaaaacaaagactttccagaaagaagagagaagcggaagctatgaaagccacagaggatggcacaccatatgatccctataaggcactgtggtttgagcggaagaaggaccctgttaccaaggagttaacccatatttataggggagaatactgggagtgtaaagaaaaacaggactggagctcatgcccggacattttctgaaacggcagtaacaaaaaagaggagcatataatggagaagaggacagaggatgtgtgggaaagctggaagttgtgactctcttaccaagtgctttcctcaagtttgtctctcttgaccaatcattttttccaaatcaatcaccagaaggagacaccagtggtggtgattggctggttgccttagctgattgaaactgaaatcgacataggagatactatgtctgtaagggagaggtttagtggccgaaggttagtgttattccacatccacgaagtcaagtattcttggctcttctttctccctctgcccccatttaagacaatgtcactcaccctccccttgtagtatcctgctcagccaagatctgcctaagattatgattcaggggcattttggtgctgttaaaagcaagagccgaatttagaagttcccttaaaaagaaacacataagacttaccaatggaggcattgtgaatggttgcagtggagcttaggtataacatcatcaagtgtgttcacacgcggggtcggtttaatggagtgtccacgcggagataactgcgatattggaacacctgtgagagagattgttctatagggctggaatattcagagttacattcttggaagtttctgtttttacttgcatcaaacacccctctgttgttctccatcatctttaatagcaactggagaccactttggtcattggtaagggggtgcattctcctcacaaaggggttttatggacttcctcaggcggagagcttctgagaacacaggcaggatggaaaaagactactagccacttttgctttcccaaccccccttaatgccatccttcattgtctttctggcttctcttcttctggcacagtaccattttgggtctgtgccccagtgtggagcaaaacattgcctgtcccattctgatatacttcagaatttgagagcagaagttaatgtggaacaaaagttttcaccatctctcaagccccaaggactggagccacctctggaataatgtgttaaatatctgtatattatatatatgtagagaaaaatctaattttttggtttgatttccttcccattaagaatcttgttttttgatacccttgtctccctgagactctttcttggacacgtgttgatgtggatggcactcctgctctccatcttttatgggcagagagatttcaaaacctgagcaggatcatgtctggcagttactaaacagggactttgtccatggtttgtatcatggggtgcctactgctgtctaaactctgctctcctaattagctgactcttgaaaatgaaatcctaacctctttcctgcctcttttctttctcttttcaggaagagtgtgggtagaaagtccggagggcaacttccaatttaattctgctctgtccggcgcataggctgaattccaaaagaactttcttcctaggatgtggggcttaaagcaccgtcatgtggggtggatcagataattgctcctgtggggccctggcttccttctctgtttgtgcagtatttgtttttgttgtcttgttgagaaatatcccctgtgcaacccacccttggttgaggatcacaaattgaggtgccttccttgtatgctttttgttagtattttttgtttttgttccttaactgctgagcctcagccagcgtgggtcctgggggaaataccattccaaaggaagccatccctatggggaaattggttttactgggtaaattaatacttttatttcttcccctatcccttccttcctagttgtgataaacatgggagaggagtgactttgactgctggggaatttcctcctaagaaccttattcccaaaataagccagggattatgtcaaggcttctttcaaggaggctcataaaagcagtgacctcatccggggctttggatagagtgagaattccccaactaaattggacttctctgctttatccccttctcttccttcaccatctgcactacatttctggctgatcccaatcagattcccgctaatggaagaagtttagaatctttcaggtggaataaagtcacatgaaaacaaaacacaactatatatattttcagtttttttgccttattgatttttttccaaaaaaaaaaaactactaaattaaataattttttaaaagtca

SEQ ID NO: 298121 - DNA, 3952 bp, Homo sapiens
tgtggttagtatttaaaagaacttgctatatcagacatttggtaaagataaccaaagtcaacaaatggggcttttcttcttgtagatcagtgctgctctggcaaaggggacatgagcgatgaagatgatgagaatgaattttttgatgcacctgagatcatcaccatgcctgaaaatttgggccacaaacgtactggcagcaatatcagtggagccagcagtgacatcagccttgatgaacagtacaagcatcagctggaggagaccaaaaaggaaaagagaaccagaataccatacaagccaaactatagcctcaatttatggagcatcatgaagaactgcattggaaaagaactctctaagatccccatgccggtaaactttaatgagcccttgtccatgcttcagcgccttactgaagatctggaataccatgagctgttagaccgagctgcaaaatgtgagaattctctagaacagctctgttatgttgcagctttcaccgtgtcctcctactccactactgtcttccgcaccagtaagccattcaacccactgcttggggagacctttgagctggaccgattagaggagaatgggtaccgatccctctgtgaacaggtaaaggaacctcagaaccataacgcatttcctttctgaagaaagagatgattttttggttaatcccctgggtcttatgtttgcagaaattctagtccctgtcatcccagcttttattctttttcttcagaacgtcagcgttggagaccctggaggttctgggattcacctactgttgtgggtgtaaaaacgtcaagtgtgaattttggtgtttctcaccaatttataggcagtatctttttcttctcctttctgccgtcttaatttgaacctgatttcttcaaggtgagtcatcatccccctgctgctgcgcaccatgctgagtccaaaaatggctggacattgcgtcaggaaatcaaaatcaccagcaagtttcgaggcaaatacctctccattatgcccctcggtaccattcattgtattttccatgcaactgggcaccactacacttggaagaaagttaccacaactgtacacaacattattgtgggcaagttgtggatagatcagtctggcgaaattgatattgtgaatcacaagacaggagacaagtgtaatcttaaatttgttccttatagctacttctctcgggatgtagcaagaaaggtgacgggggaagtgacagatccatcaggaaaagtccactttgctcttctggggacgtgggatgagaaaatggaatgtttcaaagtacagccagtcattggggaaaatgggggtgatgctcgacagagaggccatgaagcagaggaaagcagggtcatgctgtggaaaaggaatcctttaccgaagaatgcagaaaacatgtactacttctcagagcttgctctgactctcaatgcttgggaaagtggcactgcccccacagacagccggttacgacctgaccagagactgatggaaaatggacgctgggatgaagcaaatgcggagaagcagcgcctggaggaaaaacaaagactttccagaaagaagagagaagcggaagctatgaaagccacagaggatggcacaccatatgatccctataaggcactgtggtttgagcggaagaaggaccctgttaccaaggagttaacccatatttataggggagaatactgggagtgtaaagaaaaacaggactggagctcatgcccggacattttctgaaacggcagtaacaaaaaagaggagcatataatggagaagaggacagaggatgtgtgggaaagctggaagttgtgactctcttaccaagtgctttcctcaagtttgtctctcttgaccaatcattttttccaaatcaatcaccagaaggagacaccagtggtggtgattggctggttgccttagctgattgaaactgaaatcgacataggagatactatgtctgtaagggagaggtttagtggccgaaggttagtgttattccacatccacgaagtcaagtattcttggctcttctttctccctctgcccccatttaagacaatgtcactcaccctccccttgtagtatcctgctcagccaagatctgcctaagattatgattcaggggcattttggtgctgttaaaagcaagagccgaatttagaagttcccttaaaaagaaacacataagacttaccaatggaggcattgtgaatggttgcagtggagcttaggtataacatcatcaagtgtgttcacacgcggggtcggtttaatggagtgtccacgcggagataactgcgatattggaacacctgtgagagagattgttctatagggctggaatattcagagttacattcttggaagtttctgtttttacttgcatcaaacacccctctgttgttctccatcatctttaatagcaactggagaccactttggtcattggtaagggggtgcattctcctcacaaaggggttttatggacttcctcaggcggagagcttctgagaacacaggcaggatggaaaaagactactagccacttttgctttcccaaccccccttaatgccatccttcattgtctttctggcttctcttcttctggcacagtaccattttgggtctgtgccccagtgtggagcaaaacattgcctgtcccattctgatatacttcagaatttgagagcagaagttaatgtggaacaaaagttttcaccatctctcaagccccaaggactggagccacctctggaataatgtgttaaatatctgtatattatatatatgtagagaaaaatctaattttttggtttgatttccttcccattaagaatcttgttttttgatacccttgtctccctgagactctttcttggacacgtgttgatgtggatggcactcctgctctccatcttttatgggcagagagatttcaaaacctgagcaggatcatgtctggcagttactaaacagggactttgtccatggtttgtatcatggggtgcctactgctgtctaaactctgctctcctaattagctgactcttgaaaatgaaatcctaacctctttcctgcctcttttctttctcttttcaggaagagtgtgggtagaaagtccggagggcaacttccaatttaattctgctctgtccggcgcataggctgaattccaaaagaactttcttcctaggatgtggggcttaaagcaccgtcatgtggggtggatcagataattgctcctgtggggccctggcttccttctctgtttgtgcagtatttgtttttgttgtcttgttgagaaatatcccctgtgcaacccacccttggttgaggatcacaaattgaggtgccttccttgtatgctttttgttagtattttttgtttttgttccttaactgctgagcctcagccagcgtgggtcctgggggaaataccattccaaaggaagccatccctatggggaaattggttttactgggtaaattaatacttttatttcttcccctatcccttccttcctagttgtgataaacatgggagaggagtgactttgactgctggggaatttcctcctaagaaccttattcccaaaataagccagggattatgtcaaggcttctttcaaggaggctcataaaagcagtgacctcatccggggctttggatagagtgagaattccccaactaaattggacttctctgctttatccccttctcttccttcaccatctgcactacatttctggctgatcccaatcagattcccgctaatggaagaagtttagaatctttcaggtggaataaagtcacatgaaaacaaaacacaactatatatattttcagtttttttgccttattgatttttttccaaaaaaaaaaaactactaaattaaataattttttaaaagtca

SEQ ID NO: 298122 - DNA, 3883 bp, Homo sapiens
agaagagcgatgggagggggtgacgtggcagtgacaggcgcataaactgaaatgaatggcggaaacagcagccaatcggcgatcagattggccgggcattccgcattctcccgtcctccctgagcgctggaaacttcaggaaagcaccaatgagcttccccaaaagtctgattggcctttatctgaaccaatcaaaggtgggtctggcggacgcgtcccaccccaggctctcactgggcgctgtagaatgacaggcccgagagaaatgccaatatccgcggggtcttcctcaagtgacactcagcggcaccaatcgacgtccttcttcccggcggccgagccctcctccccgcggctggccgggcggggcggggacgctgcgcggcggtggctgatgcggtagccgtgtggggcgctccgggcggcgacggcggctctcgtaggcggttccggtcttgtatctccaggcggcggcggctcatggcggcgacggagctgagaggagtggtggggccaggcccggcagccattgcagcacttggcggcggcggcgccggtcccccagtggtgggaggaggcggcggccgcggagatgcggggccaggctccggggccatgcttcagcgccttactgaagatctggaataccatgagctgttagaccgagctgcaaaatgtgagaattctctagaacagctctgttatgttgcagctttcaccgtgtcctcctactccactactgtcttccgcaccagtaagccattcaacccactgcttggggagacctttgagctggaccgattagaggagaatgggtaccgatccctctgtgaacaggtgagtcatcatccccctgctgctgcgcaccatgctgagtccaaaaatggctggacattgcgtcaggaaatcaaaatcaccagcaagtttcgaggcaaatacctctccattatgcccctcggtaccattcattgtattttccatgcaactgggcaccactacacttggaagaaagttaccacaactgtacacaacattattgtgggcaagttgtggatagatcagtctggcgaaattgatattgtgaatcacaagacaggagacaagtgtaatcttaaatttgttccttatagctacttctctcgggatgtagcaagaaaggtgacgggggaagtgacagatccatcaggaaaagtccactttgctcttctggggacgtgggatgagaaaatggaatgtttcaaagtacagccagtcattggggaaaatgggggtgatgctcgacagagaggccatgaagcagaggaaagcagggtcatgctgtggaaaaggaatcctttaccgaagaatgcagaaaacatgtactacttctcagagcttgctctgactctcaatgcttgggaaagtggcactgcccccacagacagccggttacgacctgaccagagactgatggaaaatggacgctgggatgaagcaaatgcggagaagcagcgcctggaggaaaaacaaagactttccagaaagaagagagaagcggaagctatgaaagccacagaggatggcacaccatatgatccctataaggcactgtggtttgagcggaagaaggaccctgttaccaaggagttaacccatatttataggggagaatactgggagtgtaaagaaaaacaggactggagctcatgcccggacattttctgaaacggcagtaacaaaaaagaggagcatataatggagaagaggacagaggatgtgtgggaaagctggaagttgtgactctcttaccaagtgctttcctcaagtttgtctctcttgaccaatcattttttccaaatcaatcaccagaaggagacaccagtggtggtgattggctggttgccttagctgattgaaactgaaatcgacataggagatactatgtctgtaagggagaggtttagtggccgaaggttagtgttattccacatccacgaagtcaagtattcttggctcttctttctccctctgcccccatttaagacaatgtcactcaccctccccttgtagtatcctgctcagccaagatctgcctaagattatgattcaggggcattttggtgctgttaaaagcaagagccgaatttagaagttcccttaaaaagaaacacataagacttaccaatggaggcattgtgaatggttgcagtggagcttaggtataacatcatcaagtgtgttcacacgcggggtcggtttaatggagtgtccacgcggagataactgcgatattggaacacctgtgagagagattgttctatagggctggaatattcagagttacattcttggaagtttctgtttttacttgcatcaaacacccctctgttgttctccatcatctttaatagcaactggagaccactttggtcattggtaagggggtgcattctcctcacaaaggggttttatggacttcctcaggcggagagcttctgagaacacaggcaggatggaaaaagactactagccacttttgctttcccaaccccccttaatgccatccttcattgtctttctggcttctcttcttctggcacagtaccattttgggtctgtgccccagtgtggagcaaaacattgcctgtcccattctgatatacttcagaatttgagagcagaagttaatgtggaacaaaagttttcaccatctctcaagccccaaggactggagccacctctggaataatgtgttaaatatctgtatattatatatatgtagagaaaaatctaattttttggtttgatttccttcccattaagaatcttgttttttgatacccttgtctccctgagactctttcttggacacgtgttgatgtggatggcactcctgctctccatcttttatgggcagagagatttcaaaacctgagcaggatcatgtctggcagttactaaacagggactttgtccatggtttgtatcatggggtgcctactgctgtctaaactctgctctcctaattagctgactcttgaaaatgaaatcctaacctctttcctgcctcttttctttctcttttcaggaagagtgtgggtagaaagtccggagggcaacttccaatttaattctgctctgtccggcgcataggctgaattccaaaagaactttcttcctaggatgtggggcttaaagcaccgtcatgtggggtggatcagataattgctcctgtggggccctggcttccttctctgtttgtgcagtatttgtttttgttgtcttgttgagaaatatcccctgtgcaacccacccttggttgaggatcacaaattgaggtgccttccttgtatgctttttgttagtattttttgtttttgttccttaactgctgagcctcagccagcgtgggtcctgggggaaataccattccaaaggaagccatccctatggggaaattggttttactgggtaaattaatacttttatttcttcccctatcccttccttcctagttgtgataaacatgggagaggagtgactttgactgctggggaatttcctcctaagaaccttattcccaaaataagccagggattatgtcaaggcttctttcaaggaggctcataaaagcagtgacctcatccggggctttggatagagtgagaattccccaactaaattggacttctctgctttatccccttctcttccttcaccatctgcactacatttctggctgatcccaatcagattcccgctaatggaagaagtttagaatctttcaggtggaataaagtcacatgaaaacaaaacacaactatatatattttcagtttttttgccttattgatttttttccaaaaaaaaaaaactactaaattaaataattttttaaaagtca

SEQ ID NO: 298123 - DNA, 3441 bp, Homo sapiens
aatgggttgtttgcgggttaaatattagagccgctctactgagcaaagccctcttttcccagtgatttatttcctaaactgcaaaaaaaattaaactgtctcttatagatgagtgagcatagtttttatatctgttcttctccttacaggtaaactttaatgagcccttgtccatgcttcagcgccttactgaagatctggaataccatgagctgttagaccgagctgcaaaatgtgagaattctctagaacagctctgttatgttgcagctttcaccgtgtcctcctactccactactgtcttccgcaccagtaagccattcaacccactgcttggggagacctttgagctggaccgattagaggagaatgggtaccgatccctctgtgaacaggtgagtcatcatccccctgctgctgcgcaccatgctgagtccaaaaatggctggacattgcgtcaggaaatcaaaatcaccagcaagtttcgaggcaaatacctctccattatgcccctcggtaccattcattgtattttccatgcaactgggcaccactacacttggaagaaagttaccacaactgtacacaacattattgtgggcaagttgtggatagatcagtctggcgaaattgatattgtgaatcacaagacaggagacaagtgtaatcttaaatttgttccttatagctacttctctcgggatgtagcaagaaaggtgacgggggaagtgacagatccatcaggaaaagtccactttgctcttctggggacgtgggatgagaaaatggaatgtttcaaagtacagccagtcattggggaaaatgggggtgatgctcgacagagaggccatgaagcagaggaaagcagggtcatgctgtggaaaaggaatcctttaccgaagaatgcagaaaacatgtactacttctcagagcttgctctgactctcaatgcttgggaaagtggcactgcccccacagacagccggttacgacctgaccagagactgatggaaaatggacgctgggatgaagcaaatgcggagaagcagcgcctggaggaaaaacaaagactttccagaaagaagagagaagcggaagctatgaaagccacagaggatggcacaccatatgatccctataaggcactgtggtttgagcggaagaaggaccctgttaccaaggagttaacccatatttataggggagaatactgggagtgtaaagaaaaacaggactggagctcatgcccggacattttctgaaacggcagtaacaaaaaagaggagcatataatggagaagaggacagaggatgtgtgggaaagctggaagttgtgactctcttaccaagtgctttcctcaagtttgtctctcttgaccaatcattttttccaaatcaatcaccagaaggagacaccagtggtggtgattggctggttgccttagctgattgaaactgaaatcgacataggagatactatgtctgtaagggagaggtttagtggccgaaggttagtgttattccacatccacgaagtcaagtattcttggctcttctttctccctctgcccccatttaagacaatgtcactcaccctccccttgtagtatcctgctcagccaagatctgcctaagattatgattcaggggcattttggtgctgttaaaagcaagagccgaatttagaagttcccttaaaaagaaacacataagacttaccaatggaggcattgtgaatggttgcagtggagcttaggtataacatcatcaagtgtgttcacacgcggggtcggtttaatggagtgtccacgcggagataactgcgatattggaacacctgtgagagagattgttctatagggctggaatattcagagttacattcttggaagtttctgtttttacttgcatcaaacacccctctgttgttctccatcatctttaatagcaactggagaccactttggtcattggtaagggggtgcattctcctcacaaaggggttttatggacttcctcaggcggagagcttctgagaacacaggcaggatggaaaaagactactagccacttttgctttcccaaccccccttaatgccatccttcattgtctttctggcttctcttcttctggcacagtaccattttgggtctgtgccccagtgtggagcaaaacattgcctgtcccattctgatatacttcagaatttgagagcagaagttaatgtggaacaaaagttttcaccatctctcaagccccaaggactggagccacctctggaataatgtgttaaatatctgtatattatatatatgtagagaaaaatctaattttttggtttgatttccttcccattaagaatcttgttttttgatacccttgtctccctgagactctttcttggacacgtgttgatgtggatggcactcctgctctccatcttttatgggcagagagatttcaaaacctgagcaggatcatgtctggcagttactaaacagggactttgtccatggtttgtatcatggggtgcctactgctgtctaaactctgctctcctaattagctgactcttgaaaatgaaatcctaacctctttcctgcctcttttctttctcttttcaggaagagtgtgggtagaaagtccggagggcaacttccaatttaattctgctctgtccggcgcataggctgaattccaaaagaactttcttcctaggatgtggggcttaaagcaccgtcatgtggggtggatcagataattgctcctgtggggccctggcttccttctctgtttgtgcagtatttgtttttgttgtcttgttgagaaatatcccctgtgcaacccacccttggttgaggatcacaaattgaggtgccttccttgtatgctttttgttagtattttttgtttttgttccttaactgctgagcctcagccagcgtgggtcctgggggaaataccattccaaaggaagccatccctatggggaaattggttttactgggtaaattaatacttttatttcttcccctatcccttccttcctagttgtgataaacatgggagaggagtgactttgactgctggggaatttcctcctaagaaccttattcccaaaataagccagggattatgtcaaggcttctttcaaggaggctcataaaagcagtgacctcatccggggctttggatagagtgagaattccccaactaaattggacttctctgctttatccccttctcttccttcaccatctgcactacatttctggctgatcccaatcagattcccgctaatggaagaagtttagaatctttcaggtggaataaagtcacatgaaaacaaaacacaactatatatattttcagtttttttgccttattgatttttttccaaaaaaaaaaaactactaaattaaataattttttaaaagtca

SEQ ID NO: 298124 - DNA, 1916 bp, Homo sapiens
tcgagctcggtaccgactgcatccaacgccgtgactgcatccaacgccgcataagacaatgtcactcaccctccccttgtagtatcctgctcagccaagatctgcctaagattatgattcaggggcattttggtgctgttaaaagcaagagccgaatttagaagttcccttaaaaagaaacacataagacttaccaatggaggcattgtgaatggttgcagtggagcttaggtataacatcatcaagtgtgttcacacgcggggtcggtttaatggagtgtccacgcggagataactgcgatattggaacacctgtgagagagattgttctatagggctggaatattcagagttacattcttggaagtttctgtttttacttgcatcaaacacccctctgttgttctccatcatctttaatagcaactggagaccactttggtcattggtaagggggtgcattctcctcacaaaggggttttatggacttcctcaggcggagagcttctgagaacacaggcaggatggaaaaagactactagccacttttgctttcccaaccccccttaatgccatccttcattgtctttctggcttctcttcttctggcacagtaccattttgggtctgtgccccagtgtggagcaaaacattgcctgtcccattctgatatacttcagaatttgagagcagaagttaatgtggaacaaaagttttcaccatctctcaagccccaaggactggagccacctctggaataatgtgttaaatatctgtatattatatatatgtagagaaaaatctaattttttggtttgatttccttcccattaagaatcttgttttttgatacccttgtctccctgagactctttcttggacacgtgttgatgtggatggcactcctgctctccatcttttatgggcagagagatttcaaaacctgagcaggatcatgtctggcagttactaaacagggactttgtccatggtttgtatcatggggtgcctactgctgtctaaactctgctctcctaattagctgactcttgaaaatgaaatcctaacctctttcctgcctcttttctttctcttttcaggaagagtgtgggtagaaagtccggagggcaacttccaatttaattctgctctgtccggcgcataggctgaattccaaaagaactttcttcctaggatgtggggcttaaagcaccgtcatgtggggtggatcagataattgctcctgtggggccctggcttccttctctgtttgtgcagtatttgtttttgttgtcttgttgagaaatatcccctgtgcaacccacccttggttgaggatcacaaattgaggtgccttccttgtatgctttttgttagtattttttgtttttgttccttaactgctgagcctcagccagcgtgggtcctgggggaaataccattccaaaggaagccatccctatggggaaattggttttactgggtaaattaatacttttatttcttcccctatcccttccttcctagttgtgataaacatgggagaggagtgactttgactgctggggaatttcctcctaagaaccttattcccaaaataagccagggattatgtcaaggcttctttcaaggaggctcataaaagcagtgacctcatccggggctttggatagagtgagaattccccaactaaattggacttctctgctttatccccttctcttccttcaccatctgcactacatttctggctgatcccaatcagattcccgctaatggaagaagtttagaatctttcaggtggaataaagtcacatgaaaacaaaacacaactatatatattttcagtttttttgccttattgatttttttccaaaaaaaaaaaactactaaattaaataattttttaaaagtca

SEQ ID NO: 298125 - DNA, 3206 bp, Homo sapiens
agaagagcgatgggagggggtgacgtggcagtgacaggcgcataaactgaaatgaatggcggaaacagcagccaatcggcgatcagattggccgggcattccgcattctcccgtcctccctgagcgctggaaacttcaggaaagcaccaatgagcttccccaaaagtctgattggcctttatctgaaccaatcaaaggtgggtctggcggacgcgtcccaccccaggctctcactgggcgctgtagaatgacaggcccgagagaaatgccaatatccgcggggtcttcctcaagtgacactcagcggcaccaatcgacgtccttcttcccggcggccgagccctcctccccgcggctggccgggcggggcggggacgctgcgcggcggtggctgatgcggtagccgtgtggggcgctccgggcggcgacggcggctctcgtaggcggttccggtcttgtatctccaggcggcggcggctcatggcggcgacggagctgagaggagtggtggggccaggcccggcagccattgcagcacttggcggcggcggcgccggtcccccagtggtgggaggaggcggcggccgcggagatgcggggccaggctccggggccgcgtcagggacggtggtcgcggcggcggcgggaggcccgggcccgggggccgggggagtggcggcggctggcccggcccctgcgccgccgactgggggctcgggcggctcgggcgctgggggttcgggctcggctcgagagggctggctcttcaaatggaccaattatatcaaaggctaccagcggcgatggttcgtgctgagcaacgggctcctgagctactacagatcaaaggcagaaatgagacatacctgccgtggtaccatcaacctcgccacagccaacatcaccgtggaggactcctgcaacttcatcatttccaatgggggtgctcagacctaccatctgaaagctagttcagaagttgagcggcagcgctgggtgacggccctggaactggccaaggccaaagctgtgaagatgctggcagagtcagatgaatcaggagatgaagagtctgtctcacaaactgacaagactgagctgcagaatacccttcggaccctctctagcaaagtagaggacttgagcacgtgcaatgacttgatagctaagcatggcacagctctgcagcgttctctcagtgagctggagtccctgaagttgcctgctgagagcaatgaaaagatcaaacaggtcaacgaacgagccacactctttaggataacatccaatgccatgatcaacgcctgcagagatttcctcatgttagcccagacccatagtaaaaaatggcaaaagtcactacagtatgaaagagaccagcgtatccgactggaagaaaccctcgagcagctggcgaagcagcataatcacctggagagggccttccgaggagccacggtgctgccggcaaacactcctggcaatgtgggttctggtaaagatcagtgctgctctggcaaaggggacatgagcgatgaagatgatgagaatgaattttttgatgcacctgagatcatcaccatgcctgaaaatttgggccacaaacgtactggcagcaatatcagtggagccagcagtgacatcagccttgatgaacagtacaagcatcagctggaggagaccaaaaaggaaaagagaaccagaataccatacaagccaaactatagcctcaatttatggagcatcatgaagaactgcattggaaaagaactctctaagatccccatgccggtaaactttaatgagcccttgtccatgcttcagcgccttactgaagatctggaataccatgagctgttagaccgagctgcaaaatgtgagaattctctagaacagctctgttatgttgcagctttcaccgtgtcctcctactccactactgtcttccgcaccagtaagccattcaacccactgcttggggagacctttgagctggaccgattagaggagaatgggtaccgatccctctgtgaacaggtaaaggaacctcagaaccataacgcatttcctttctgaagaaagagatgattttttggttaatcccctgggtcttatgtttgcagaaattctagtccctgtcatcccagcttttattctttttcttcagaacgtcagcgttggagaccctggaggttctgggattcacctactgttgtgggtgtaaaaacgtcaagtgtgaattttggtgtttctcaccaatttataggcagtatctttttcttctcctttctgccgtcttaatttgaacctgatttcttcaaggtgagtcatcatccccctgctgctgcgcaccatgctgagtccaaaaatggctggacattgcgtcaggaaatcaaaatcaccagcaagtttcgaggcaaatacctctccattatgcccctcggtaaggttaccatctttgtcagaattaatgctcctggaatgaaaggttttctggcacgatggaggaggtcactggctaaagagtcaggagacaggaggtctgattcgagcactgaccctcactaactggctttgggcaggtatttaacttttcagctatcaaatgagtgtggaggctagaaactctttaaggacccatctagtcctaaattctttatcctcttagctatatttaacgcatctctaagcactatttagaacacaagttctagcatgcattaaaaaaaaaaattcgtctcttaactggtggtgttttcttccttactttggcagtcaggttctctctgtaaatcagaactcatgattgcaaggttaggtttcttagctaatccttccgctttctcctctccttcctcccttttcctccacctgatgggttaggtatcatttatgtaatggctgaattctaggtcactgaaactttattttaaaaagatcttacttggggctgggcacagtgcctcacccctgtaatcctagcactttgggaggccagggcaggcagattgtctgagctctggagttcaagaccagcctgggcaacatggtgaaaccctgtctttactaagaatacaaaaaaattagctgggtgtggtggtgcacacctgtagtctcagctactcgggaggctgaggcacaagaattgcttgaacccgggaggcggaggtttcagtgagctgagattgcactattgcactccagcc

SEQ ID NO: 298126 - DNA, 453 bp, Homo sapiens
ccgcgtcagggacggtggtcgcggcggcggcgggaggcccgggcccgggggccgggggagtggcggcggctggcccggcccctgcgccgccgactgggggctcgggcggctcgggcgctgggggttcgggctcggctcgagagggctggctcttcaaatggaccaattatatcaaaggctaccagcggcgatggttcgtgctgagcaacgggctcctgagctactacaggtaactgcttccggggcgctgtcgctcaccttgcctcccccatatctgccaacagtcccagctccggcattaccgccagccggcaccgcagccagggttgccccaggccccttttcgtcatctgtgcggattgacagcccaggggtcggagcccactgtcacgaaagtgaaaagcccctggacgtacacctcccctcccctcgggttacccactcttggtgcct

SEQ ID NO: 298127 - DNA, 240 bp, Homo sapiens
gagcaagatcccatctctaataataatttggatgactctctggtgtttgttataacaggacctaaccattatttatcctaggacttccagtatagtcaggtaagctaattcacagtgaattctatatagccaagccctgttctccacccttgcaggtgacgggggaagtgacagatccatcaggaaaagtccactttgctcttctggggacgtgggatgagaaaatggaatgtttcaaag

SEQ ID NO: 298128 - DNA, 249 bp, Homo sapiens
cagccggttacgacctgaccagagactgatggaaaatggacgctgggatgaagcaaatgcggagaagcagcgcctggaggaaaaacaaagactttccagaaagaagagagaagcggaagctatgaaagccacagaggatggtaatgaacttcccttctactcttctttcttgatgcatggagaatgccagcactaatttttttctttcctctcttttccttttaggcacaccatatgatccctataagg

SEQ ID NO: 298129 - DNA, 859 bp, Homo sapiens
tggaaagaatcacattttaatattttttaatgatttgtacaagcatgtacttgtatacatacaacagtatgtctggacatttgtctgctgaaaaagtacttgtttcctctgcggaaggaggggcaggcagtgaagagggaacttctactttgaattcggcacatgtctggttttatgaacaagcatgtactccttttgtgacttttaagaatcagtacaaattttttcaaaggagatagaatgtgacgaaaagcacacccagcaggctacccagaggtgcatgtgttccctaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggtgggagccggatttcttttttttttttttttccccttgaaaagattgttgccataacagagggatttcttgcataaacaaaggaaagagagggagagggagagagattagagttggaaaatactcatcagagatgctaatttgttcccggctgacaggaaaaatgcttcttgtcctcctgggaactgagcagcagaagcagcaggaagttgacgtgcagaattaggctctgccctttgtaagcctcaggctgctctgcctttccccactgccccgccacccccagccccagggaggggtagcacttgggggcctctgggccccagagcttctgcacctgctcctttgatgatcctttgaatttgaaaaggattaaagggaaaaaaaatctctagtaagaaaaaggatttcctctttcccatcttaaaaaaa

SEQ ID NO: 298130 - DNA, 783 bp, Homo sapiens
agcgggggggcaagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccaggcatgggctgatgcctttcgaagcagtcctgatctcaccggcgttgtgcacatatatgaggagctgaagaggaaaggggttgaatttcccatggcagacttggacgctctgtctcccatacacacaccacagcggagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacaggtacttgcatacttcggggcc

SEQ ID NO: 298131 - DNA, 502 bp, Homo sapiens
  misc_feature (474)..(474): n is a, c, g, or t
  misc_feature (502)..(502): n is a, c, g, or t
tggaaagaatcacattttaatattttttaatgatttgtacaagcatgtacttgtatacatacaacagtatgtctggacatttgtctgctgaaaaagtacttgtttcctctgcggaaggaggggcaggcagtgaagagggaacttctactttgaattcggcacatgtctggttttatgaacaagcatgtactccttttgtgacttttaagaatcagtacaaattttttcaaaggagatagaatgtgacgaaaagcacacccagcaggctacccagaggtgcatgtgttccctaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggtgggagccggatttctttttttttttttttttggttttgaccaagntagggccgatggcagatgacttaccgan

SEQ ID NO: 298132 - DNA, 3249 bp, Homo sapiens
cacagatgtgcacatgggccacactcagtgctgtggcctggcctgccgtagcctcacacatctgcctcaagagccagcagcaaacagctttgtggcatccttggaggttcccagtgactgagaggcctgggcagcactaaggcccctgctctgctccctggcataggccttggcctccttgcacagactctcctgacagtctggcctcctcccacctcagaggtcctctggccaccaatttatactctctccccaagctgatcctgaaggcaggcagagcagctaggggctggtaacatgtattcccatcccgtgtcctcactggtgtgtctcctggccatgggcaagggactcgggtcatcccaggccctggtccagccagacacctggccccacacctcccaccaggctgctgttgctcagaaggagaatactgcagctgtatgcatccccgtgtgtcttgggcccagctcgctgggtcagtctgctcctgtcccctccagcatgcactgcctaggtcagcacaggttcctgatccatggtgtagttagcccttcccacctggcaggacggcccagaccaccagccaagcagggaaagggggctgggcttgacgggagaagagaccagcgacatggtcgttggggagcattcaggatggcgacttcagctgggggtcatgctgagcaccaacaggaactattccagtgaagagcaagtgctgcccgacccaggaccctgtgccaggctagcagccctccagctccctccagagaggaaacctctgtctggctgagggtgggactagctgggatgtctcactccagttgctcaggttcacccaggaagctcctccgtggagtggccagcctgattctagccctgtcctctctggcagcacatgccacacctgcctgggccttctgctccctgatgcttgatgagcccctgcctcctcaatgtttctcaaagacagacccccctgaggccagcttgaatgtgaagactgctgaagtcagctggcttcacttgagctgcagaaaaggtggctgggatggcccaggtgcacccagaggccccagccctttggctgcctttgggttgtgacttgggttgtctctgaggccctgccagagctgggcctgcgggtggtgggcggtccgacctcgggcagtcagtgctccgcagcctcagcactgcatcccagacccagtgtcctcagagggaagagccagcctccctgcctcatggaaccaggagtcccaaaaagtcaggagcctggaggctctgaaaggagcagggattccatagtgcgtgaagctgaaataggcgccctcctggggagcccccagcaaaactgtttttcatacccactcccagaactgccccgctccagctccagcgccagcgccagctggttgccaggcgtcattggagaggcctggctgccccaggggcagcagggagtggtggacctgtatgggctggcaggaggccattggccatgctgacaagtgtcacctgccttcctagcctggagccacccctcaggtggcctgcttgcacctcctatccggaggtagcctgccccacctgtaggcagagggggctcttgcttgaggcctgcacaggaagcaagtatagccccggtgccccagagtgggttccacttagccctggcgagatggcctgtcctgagatctctgctcccagaccccaccatctggggagcacagtccttaggctgcctggtccaggaagggggtgcggctctgtcaggaaacctggactctcaaggcccaccagcctctccgtgagtgttagaaatcacagatacagtatatacttaattacactaaattattgctgggattccttataagcactaattatacctgattataggttaaaatatttattttgtcaaaatattttcttgggaatgtgtttaaccctttctgcgttcattgttgctgagatgtgaaaactaaccattccctcctgcctacctttttggccactgggcggcagagaatggcgctatgtgcagttgggcccccggcaccatgggcctttggcctgcctgctgcagagtagccctgcctgggcagtctccaggcactgagcaggccatctgtggccaggctgagagaatgactggctcgcttaccagcgtgcatgggacaaggagctttggagcctcaaggggttgttgctggcctgggctagagggaaaggtgaccatccgtctgtcctcctgtctttctattagcgcctccatgtgagtgatggtgccttggttcactagccttcccccaccaccccaccatgccacctggtggtcttggggcctgtgctgtcactccagcccctggggaggagaggacccagcccggagagttggggcaagggctccacatggcccaagggcaacagatgctcgcagggcagctgctgccgatgctcacgctcctgcccccctccttcccgctgccacaccccaccctgggcccccgcagacacgcatctctaactcagttgggcccagccttctggatggcttggggtaggccatgggcccacctggggccaggccagcccctggggcagctctggaagagcagtgtggaggagcacttgcttgcagcctggcttcagcctctggcactgctggagtggtccctgggagcttctgcactgtcggctttggggacgtctcacccacttgggttacagtaggccttccccacccagagagaagtgtttccaccccagagacattgcctgtcagcccctgaagtgctcgcctcccccagtgcccgtcaccagcccttcctatctgtggggtccaagtcaggcttcccctgcggccaccagccatagggagcagccatcagcccccgagtcagaactgcttctgtctgtccatacctccaggctctcccggagagggggacggatatttatttcctaaagtttgcacttaattgtgaggattctcaggattgttgggggctactgaaaagaggaatgtgttgaatgtcgcgtttgctgtccactcgtcctagaagtttagtgtttttgtcactgtcatgtgtttctgtgggcagagctggttctggagggtgggtcagtgcacccgaggctcagagcatccatccaccccactggccctccttccagataccctctctctaattgggttcttgcatgtaaaatactccacaataaataaataattgaacaaat

SEQ ID NO: 298133 - DNA, 3236 bp, Homo sapiens
cacagatgtgcacatgggccacactcagtgctgtggcctggcctgccgtagcctcacacatctgcctcaagagccagcagcaaacagctttgtggcatccttggaggttcccagtgactgagaggcctgggcagcactaaggcccctgctctgctccctggcataggccttggcctccttgcacagactctcctgacagtctggcctcctcccacctcagaggtcctctggccaccaatttatactctctccccaagctgatcctgaaggcaggcagagcagctaggggctggtaacatgtattcccatcccgtgtcctcactggtgtgtctcctggccatgggcaagggactcgggtcatcccaggccctggtccagccagacacctggccccacacctcccaccaggctgctgttgctcagaaggagaatactgcagctgtatgcatccccgtgtgtcttgggcccagctcgctgggtcagtctgctcctgtcccctccagcatgcactgcctaggtcagcacaggttcctgatccatggtgtagttagcccttcccacctggcaggacggcccagaccaccagccaagcagggaaagggggctgggcttgacgggagaagagaccagcgacatggtcgttggggagcattcaggatggcgacttcagctgggggtcatgctgagcaccaacaggaactattccagtgaagagcaagtgctgcccgacccaggaccctgtgccaggctagcagccctccagctccctccagagaggaaacctctgtctggctgagggtgggactagctgggatgtctcactccagttgctcaggttcacccaggaagctcctccgtggagtggccagcctgattctagccctgtcctctctggcagcacatgccacacctgcctgggccttctgctccctgatgcttgatgagcccctgcctcctcaatgtttctcaaagacagacccccctgaggccagcttgaatgtgaagactgctgaagtcagctggcttcacttgagctgcagaaaaggtggctgggatggcccaggtgcacccagaggccccagccctttggctgcctttgggttgtgacttgggttgtctctgaggccctgccagagctgggcctgcgggtggtgggcggtccgacctcgggcagtcagtgctccgcagcctcagcactgcatcccagacccagtgtcctcagagggaagagccagcctccctgcctcatggaaccaggagtcccaaaaagtcaggagcctggaggctctgaaaggagcagggattccatagtgcgtgaagctgaaataggcgccctcctggggagcccccagcaaaactgtttttcatacccactcccagaactgccccgctccagctccagcgccagcgccagctggttgccaggcgtcattggagaggcctggctgccccaggggcagcagggagtggtggacctgtatgggctggcaggaggccattggccatgctgacaagtgtcacctgccttcctagcctggagccacccctcaggtggcctgcttgcacctcctatccggaggtagcctgccccacctgtaggcagagggggctcttgcttgaggcctgcacaggaagcaagtatagccccggtgccccagagtgggttccacttagccctggcgagatggcctgtcctgagatctctgctcccagaccccaccatctggggagcacagtccttaggctgcctggtccaggaagggggtgcggctctgtcaggaaacctggactctcaaggcccaccagcctctccgtgagtgttagaaatcacagatacagtatatacttaattacactaaattattgctgggattccttataagcactaattatacctgattataggttaaaatatttattttgtcaaaatattttcttgggaatgtgtttaaccctttctgcgttcattgttgctgagatgtgaaaactaaccattccctcctgcctacctttttggccactgggcggcagagaatggcgctatgtgcagttgggcccccggcaccatgggcctttggcctgcctgctgcagagtagccctgcctgggcagtctccaggcactgagcaggccatctgtggccaggctgagagaatgactggctcgcttaccagcgtgcatgggacaaggagctttggagcctcaaggggttgttgctggcctgggctagagggaaaggtgaccatccgtctgtcctcctgtctttctattagcgcctccatgtgagtgatggtgccttggttcactagccttcccccaccaccccaccatgccacctggtggtcttggggcctgtgctgtcactccagcccctggggaggagaggacccagcccggagagttggggcaagggctccacatggcccaagggcaacagatgctcgcagggcagctgctgccgatgctcacgctcctgcccccctccttcccgctgccacaccccaccctgggcccccgcagacacgcatctctaactcagttgggcccagccttctggatggcttggggtaggccatgggcccacctggggccaggccagcccctggggcagctctggaagagcagtgtggaggagcacttgcttgcagcctggcttcagcctctggcactgctggagtggtccctgggagcttctgcactgtcggctttggggacgtctcacccacttgggttacagtaggccttccccacccagagagaagtgtttccaccccagagacattgcctgtcagcccctgaagtgctcgcctcccccagtgcccgtcaccagcccttcctatctgtggggtccaagtcaggcttcccctgcggccaccagccatagggagcagccatcagcccccgagtcagaactgcttctgtctgtccatacctccaggctctcccggagagggggacggatatttatttcctaaagtttgcacttaattgtgaggattctcaggattgttgggggctactgaaaagaggaatgtgttgaatgtcgcgtttgctgtccactcgtcctagaagtttagtgtttttgtcactgtcatgtgtttctgtgggcagagctggttctggagggtgggtcagtgcacccgaggctcagagcatccatccaccccactggccctccttccagataccctctctctaattgggtggaaacacttctctgtcgacgcggccgcgaat

SEQ ID NO: 298134 - DNA, 3414 bp, Homo sapiens
cacagatgtgcacatgggccacactcagtgctgtggcctggcctgccgtagcctcacacatctgcctcaagagccagcagcaaacagctttgtggcatccttggaggttcccagtgactgagaggcctgggcagcactaaggcccctgctctgctccctggcataggccttggcctccttgcacagactctcctgacagtctggcctcctcccacctcagaggtcctctggccaccaatttatactctctccccaagctgatcctgaaggcaggcagagcagctaggggctggtaacatgtattcccatcccgtgtcctcactggtgtgtctcctggccatgggcaagggactcgggtcatcccaggccctggtccagccagacacctggccccacacctcccaccaggctgctgttgctcagaaggagaatactgcagctgtatgcatccccgtgtgtcttgggcccagctcgctgggtcagtctgctcctgtcccctccagcatgcactgcctaggtcagcacaggttcctgatccatggtgtagttagcccttcccacctggcaggacggcccagaccaccagccaagcagggaaagggggctgggcttgacgggagaagagaccagcgacatggtcgttggggagcattcaggatggcgacttcagctgggggtcatgctgagcaccaacaggaactattccagtgaagagcaagtgctgcccgacccaggaccctgtgccaggctagcagccctccagctccctccagagaggaaacctctgtctggctgagggtgggactagctgggatgtctcactccagttgctcaggttcacccaggaagctcctccgtggagtggccagcctgattctagccctgtcctctctggcagcacatgccacacctgcctgggccttctgctccctgatgcttgatgagcccctgcctcctcaatgtttctcaaagacagacccccctgaggccagcttgaatgtgaagactgctgaagtcagctggcttcacttgagctgcagaaaaggtggctgggatggcccaggtgcacccagaggccccagccctttggctgcctttgggttgtgacttgggttgtctctgaggccctgccagagctgggcctgcgggtggtgggcggtccgacctcgggcagtcagtgctccgcagcctcagcactgcatcccagacccagtgtcctcagagggaagagccagcctccctgcctcatggaaccaggagtcccaaaaagtcaggagcctggaggctctgaaaggagcagggattccatagtgcgtgaagctgaaataggcgccctcctggggagcccccagcaaaactgtttttcatacccactcccagaactgccccgctccagctccagcgccagcgccagctggttgccaggcgtcattggagaggcctggctgccccaggggcagcagggagtggtggacctgtatgggctggcaggaggccattggccatgctgacaagtgtcacctgccttcctagcctggagccacccctcaggtggcctgcttgcacctcctatccggaggtagcctgccccacctgtaggcagagggggctcttgcttgaggcctgcacaggaagcaagtatagccccggtgccccagagtgggttccacttagccctggcgagatggcctgtcctgagatctctgctcccagaccccaccatctggggagcacagtccttaggctgcctggtccaggaagggggtgcggctctgtcaggaaacctggactctcaaggcccaccagcctctccgtgagtgttagaaatcacagatacagtatatacttaattacactaaattattgctgggattccttataagcactaattatacctgattataggttaaaatatttattttgtcaaaatattttcttgggaatgtgtttaaccctttctgcgttcattgttgctgagatgtgaaaactaaccattccctcctgcctacctttttggccactgggcggcagagaatggcgctatgtgcagttgggcccccggcaccatgggcctttggcctgcctgctgcagagtagccctgcctgggcagtctccaggcactgagcaggccatctgtggccaggctgagagaatgactggctcgcttaccagcgtgcatgggacaaggagctttggagcctcaaggggttgttgctggcctgggctagagggaaaggtgaccatccgtctgtcctcctgtctttctattagcgcctccatgtgagtgatggtgccttggttcactagccttcccccaccaccccaccatgccacctggtggtcttggggcctgtgctgtcactccagcccctggggaggagaggacccagcccggagagttggggcaagggctccacatggcccaagggcaacagatgctcgcagggcagctgctgccgatgctcacgctcctgcccccctccttcccgctgccacaccccaccctgggcccccgcagacacgcatctctaactcagttgggcccagccttctggatggcttggggtaggccatgggcccacctggggccaggccagcccctggggcagctctggaagagcagtgtggaggagcacttgcttgcagcctggcttcagcctctggcactgctggagtggtccctgggagcttctgcactgtcggctttggggacgtctcacccacttgggttacagtaggccttccccacccagagagaagtgtttccaccccagagacattgcctgtcagcccctgaagtgctcgcctcccccagtgcccgtcaccagcccttcctatctgtggggtccaagtcaggcttcccctgcggccaccagccatagggagcagccatcagcccccgagtcagaactgcttctgtctgtccatacctccaggctctcccggagagggggacggatatttatttcctaaagtttgcacttaattgtgaggattctcaggattgttgggggctactgaaaagaggaatgtgttgaatgtcgcgtttgctgtccactcgtcctagaagtttagtgtttttgtcactgtcatgtgtttctgtgggcagagctggttctggagggtgggtcagtgcacccgaggctcagagcatccatccaccccactggccctccttccagataccctctctctaattgggttcttgcatgtaaaatactccacaataaataaataattgaacaaatcagccaaccgacagagcccgagggggggccgggaccaatgcgcctaaaagagtgtatccagaccagggcggcgaaaaaggccgaccgggaaccgtggtgcaaacaaagcgggggaaccccctgcacggggaacgccccgagcgccgggacgcagggggggagcac

SEQ ID NO: 298135 - DNA, 889 bp, Homo sapiens
agcgggggggcaagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccaggcatgggctgatgcctttcgaagcagtcctgatctcaccggcgttgtgcacatatatgaggaccatcagcccccgagtcagaactgcttctgtctgtccatacctccaggctctcccggagagggggacggatatttatttcctaaagtttgcacttaattgtgaggattctcaggattgttgggggctactgaaaagaggaatgtgttgaatgtcgcgtttgctgtccactcgtcctagaagtttagtgtttttgtcactgtcatgtgtttctgtgggcagagctggttctggagggtgggtcagtgcacccgaggctcagagcatccatccaccccactggccctccttccagataccctctctctaattgggttcttgcatgtaaaatactccacaataaataaataattgaacaaat

SEQ ID NO: 298136 - DNA, 1445 bp, Homo sapiens
agcgggggggcaagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccaggcatgggctgatgcctttcgaagcagtcctgatctcaccggcgttgtgcacatatatgaggagctgaagaggaaaggggttgaatttcccatggcagacttggacgctctgtctcccatacacacaccacagcggagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggtgggagccggatttcttttttttttttttttccccttgaaaagattgttgccataacagagggatttcttgcataaacaaaggaaagagagggagagggagagagattagagttggaaaatactcatcagagatgctaatttgttcccggctgacaggaaaaatgcttcttgtcctcctgggaactgagcagcagaagcagcaggaagttgacgtgcagaattaggctctgccctttgtaagcctcaggctgctctgcctttccccactgccccgccacccccagccccagggaggggtagcacttgggggcctctgggccccagagcttctgcacctgctcctttgatgatcctttgaatttgaaaaggattaaagggaaaaaaaatctctagtaagaaaaaggatttcctctttcccatcttaaaaaaa

SEQ ID NO: 298137 - DNA, 1295 bp, Homo sapiens
agcgggggggcaagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagcatgggctgatgcctttcgaagcagtcctgatctcaccggcgttgtgcacatatatgaggagctgaagaggaaaggggttgaatttcccatggcagacttggacgctctgtctcccatacacacaccacagcggagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggtgggagccggatttcttttttttttttttttccccttgaaaagattgttgccataacagagggatttcttgcataaacaaaggaaagagagggagagggagagagattagagttggaaaatactcatcagagatgctaatttgttcccggctgacaggaaaaatgcttcttgtcctcctgggaactgagcagcagaagcagcaggaagttgacgtgcagaattaggctctgccctttgtaagcctcaggctgctctgcctttccccactgccccgccacccccagccccagggaggggtagcacttgggggcctctgggccccagagcttctgcacctgctcctttgatgatcctttgaatttgaaaaggattaaagggaaaaaaaatctctagtaagaaaaaggatttcctctttcccatcttaaaaaaa

SEQ ID NO: 298138 - DNA, 1310 bp, Homo sapiens
agcgggggggcaagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaatatggagatctgtgacatcatcaatgagacggaggaagggccaaaggatgccattcgagccctgaagaagcggctcaacgggaaccggaactacagagaggtgatgctggcattaacagtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccagagtgtccctgaagtggatccagctgcgaccatgcccaggtcccaatcacagcagaggacaagtgctggttcctattcctcgccgcctcctgctccctactccgcaccgcaggccccagctctgagtgtgactggccccatcacagccaattcagaacagattgccaggctgcggagtgaactggacgtcgttcgaggaaacacaaaagtcatgtctgagatgttaacagaaatggtccctggacaggaggattcatctgatctggagttgctgcaggagctcaacaggacctgtcgggccatgcagcagcgcatcgtggagctcatctcccgcgtgtccaatgaggaggtcaccgaggagctgctgcatgtgaacgatgacctcaacaacgtcttccttcgatacgagaggtgggagccggatttcttttttttttttttttccccttgaaaagattgttgccataacagagggatttcttgcataaacaaaggaaagagagggagagggagagagattagagttggaaaatactcatcagagatgctaatttgttcccggctgacaggaaaaatgcttcttgtcctcctgggaactgagcagcagaagcagcaggaagttgacgtgcagaattaggctctgccctttgtaagcctcaggctgctctgcctttccccactgccccgccacccccagccccagggaggggtagcacttgggggcctctgggccccagagcttctgcacctgctcctttgatgatcctttgaatttgaaaaggattaaagggaaaaaaaatctctagtaagaaaaaggatttcctctttcccatcttaaaaaaa

SEQ ID NO: 298139 - DNA, 286 bp, Homo sapiens
tccagctcccactggggtgacccttttccttccctccccacatcaggtgctggagacatgtgtgaagaactgtggccaccgcttccacatccttgtggccaaccgagatttcatcgacagtgttctggtcaaaattatatctcccaagaacaaccctcccaccattgtacaggacaaagtgcttgctctgatccaggtaggttggaccccttgcccaatttgttggaacagagtaagatgaagtctcttattgatgagtcctcatgctctcccaccatttggagga

SEQ ID NO: 298140 - DNA, 353 bp, Homo sapiens
tctttttctgggtgccggttaggttcatctatttaccagtaaaattttagtgaggaaaccagatcgccttctacatgcacttagtagccttgttcactgaagattaaaacaaggcttttaaacctatgctttgaaaacttaaaaagaaaaaatttttgaattcatcactgagtactactaagagggggacaaggtttttggctacagggagaaacttgtgtacactttctgtgacatagctgataatttgaaagatgaaagtgaacctgacaaaactgttcaagttgaacaacctgaagcaatttaaggtccattcatcagtccatagattttttttaccaagtagttttaga

SEQ ID NO: 298141 - DNA, 11966 bp, Homo sapiens
cgcgcgcgtcggcctctcggagagagggctgtggtaaaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccgtcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaatttacataaaaatgtccgtttgtgtcttttgttgtaaaaatcaagtgattttttcataaggttcttttactattggaaaagatgggcagcacgcagttttattttatttttgtaagttttttaatacatgtgaaagcaaagaatactcagcatgcctttctaagtgacgcgtttgcaccttttgttgggaagtactgtatcctgtgctgttagcattctcgataaatctctctgtgaaagtgactcaaggtctgggctttcattataagacagaagtccccctccagctcacatgacagcatggtgctgcgtttcctcattggatctggctgtccctggacacaggtagctgccttcaggcctgccacgagcggccaagggaagcctcctccatatgctggcctcgctggcccctcagcttcttccaagccagtgctctccaggcacactgctccagcgtgtgacgggaagggcctggcatgagtcagcctgcagcacaacctccctgctccagacccgtatggtaggggcaccccctaggtctggatgtgctgtggtgcttttggacacccccacccccgcaggctgtggctcctcctgtgtctcattctggccaggaccctcacgtgccctctgttgactgctaacgtggttctctgaccaggcaagggcaggctgaggggtttgcccaaagggggcccccttgttactggcttccttggctctcaggagcagcctcaccaggttggtaaggggctggaggagacaactgctcaaaggagtccagcttcacatgcacatgctagaaggtaccctcggaaggcctggccttcaaaggtagatcccagggttgaaaagtcaacttgtatgcattgagcatctcgtatgccagccctgttccgtgagctgatgggcctttgtgtgtaagtaggaccaagtgcccccgtggaggttagcatgggtgtgcagtcatttcagatacttgagttggtacatctcagtaaagtctgtcccgtgagaagccatgggtttcatggtatggttggcatcttccttgggagtggccacagtggtggtggcttcaggaaagagactccaacaggggccagctgtgggccttgggcacttctcgtttctaggaaaagtcctaagtctgtagggctaggggtggggaaccccttcgctgtcaggatcaagagggcaaggggaactgtcgctggaggagacatccagctggagaaacaaaagagtaagtctgcgttgctgcttgtggggtcttccccatctcagggcggggaccgggggtggcggtccagacaagtaatcaaggacgatgcccaggaggggacaggtacggggtggcaggagctctgccggcgggctcaggaagccttcaccacagctgcctgagctcacccttgccaaatgagggctggggcagcagcaacgcatacactcacggctgtggcgggcagcgttctcggcatatttcaggacacctaaggagactgaatggctcaaggctgctgccgtgtgcagggggctagacgtggggcgggcaggcagggctcctggtaacagccctgcaggccgcagtggagagcagggttccggcagggccgcccaggagctttcggaaggcccggccccggcccctttccgagcagcccgggcctccgccctgccctctgtccccaacgccgggagccgccgttcgtcctccagagccccgcccgggcgagc

SEQ ID NO: 298142 - DNA, 11589 bp, Homo sapiens
cgcgcgcgtcggcctctcggagagagggctgtggtaaaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccgtcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaatttacataaaaatgtccgtttgtgtcttttgttgtaaaaatcaagtgattttttcataaggttcttttactattggaaaagatgggcagcacgcagttttattttatttttgtaagttttttaatacatgtgaaagcaaagaatactcagcatgcctttctaagtgacgcgtttgcaccttttgttgggaagtactgtatcctgtgctgttagcattctcgataaatctctctgtgaaagtgactcaaggtctgggctttcattataagacagaagtccccctccagctcacatgacagcatggtgctgcgtttcctcattggatctggctgtccctggacacaggtagctgccttcaggcctgccacgagcggccaagggaagcctcctccatatgctggcctcgctggcccctcagcttcttccaagccagtgctctccaggcacactgctccagcgtgtgacgggaagggcctggcatgagtcagcctgcagcacaacctccctgctccagacccgtatggtaggggcaccccctaggtctggatgtgctgtggtgcttttggacacccccacccccgcaggctgtggctcctcctgtgtctcattctggccaggaccctcacgtgccctctgttgactgctaacgtggttctctgaccaggcaagggcaggctgaggggtttgcccaaagggggcccccttgttactggcttccttggctctcaggagcagcctcaccaggttggtaaggggctggaggagacaactgctcaaaggagtccagcttcacatgcacatgctagaaggtaccctcggaaggcctggccttcaaaggtagatcccagggttgaaaagtcaacttgtatgcattgagcatctcgtatgccagccctgttccgtgagctgatgggcctttgtgtgtaagtaggaccaagtgcccccgtggaggttagcatgggtgtgcagtcatttcagatacttgagttggtacatctcagtaaagtctgtcccgtgagaagccatgggtttcatggtatggttggcatcttccttgggagtggccacagtggtggtggcttcaggaaagagactccaacaggggccagctgtgggccttgggcacttctcgtttctaggaaaagtcctaagtctgtagggctaggggtggggaaccccttcgctgtcaggatcaagagggcaaggggaactgtcgctggaggagacatccagctggagaaacaaaagagtaagtctgcgttgctgcttgtggggtcttccccatctcagggcggggaccgggggtggcggtccagacaagtaatcaaggacgatgcccaggaggggacaggtacggggtggcaggagctctgccggcgggctcaggaagccttcaccacagctgcctgagctcacccttgccaaatgagggctggggcagcagcaacgcatacactcacggctgtggcgggcagcgttctcggcatatttcaggacacctaaggagactgaatggctcaaggctgctgccgtgtgcagggggctagacgtggggcgggcaggcagggctcctggtaacagccctgcaggccgcagtggagagcagggttccggcagggccgcccaggagctttcggaaggcccggccccggcccctttccgagcagcccgggcctccgccctgccctctgtccccaacgccgggagccgccgttcgtcctccagagccccgcccgggcgagc

SEQ ID NO: 298143 - DNA, 11842 bp, Homo sapiens
cgcgcgcgtcggcctctcggagagagggctgtggtaaaagccgtccggaaaatggccgccgccgccgccgccgcgccgagcggaggaggaggaggaggcgaggaggagagactggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccgtcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaatttacataaaaatgtccgtttgtgtcttttgttgtaaaaatcaagtgattttttcataaggttcttttactattggaaaagatgggcagcacgcagttttattttatttttgtaagttttttaatacatgtgaaagcaaagaatactcagcatgcctttctaagtgacgcgtttgcaccttttgttgggaagtactgtatcctgtgctgttagcattctcgataaatctctctgtgaaagtgactcaaggtctgggctttcattataagacagaagtccccctccagctcacatgacagcatggtgctgcgtttcctcattggatctggctgtccctggacacaggtagctgccttcaggcctgccacgagcggccaagggaagcctcctccatatgctggcctcgctggcccctcagcttcttccaagccagtgctctccaggcacactgctccagcgtgtgacgggaagggcctggcatgagtcagcctgcagcacaacctccctgctccagacccgtatggtaggggcaccccctaggtctggatgtgctgtggtgcttttggacacccccacccccgcaggctgtggctcctcctgtgtctcattctggccaggaccctcacgtgccctctgttgactgctaacgtggttctctgaccaggcaagggcaggctgaggggtttgcccaaagggggcccccttgttactggcttccttggctctcaggagcagcctcaccaggttggtaaggggctggaggagacaactgctcaaaggagtccagcttcacatgcacatgctagaaggtaccctcggaaggcctggccttcaaaggtagatcccagggttgaaaagtcaacttgtatgcattgagcatctcgtatgccagccctgttccgtgagctgatgggcctttgtgtgtaagtaggaccaagtgcccccgtggaggttagcatgggtgtgcagtcatttcagatacttgagttggtacatctcagtaaagtctgtcccgtgagaagccatgggtttcatggtatggttggcatcttccttgggagtggccacagtggtggtggcttcaggaaagagactccaacaggggccagctgtgggccttgggcacttctcgtttctaggaaaagtcctaagtctgtagggctaggggtggggaaccccttcgctgtcaggatcaagagggcaaggggaactgtcgctggaggagacatccagctggagaaacaaaagagtaagtctgcgttgctgcttgtggggtcttccccatctcagggcggggaccgggggtggcggtccagacaagtaatcaaggacgatgcccaggaggggacaggtacggggtggcaggagctctgccggcgggctcaggaagccttcaccacagctgcctgagctcacccttgccaaatgagggctggggcagcagcaacgcatacactcacggctgtggcgggcagcgttctcggcatatttcaggacacctaaggagactgaatggctcaaggctgctgccgtgtgcagggggctagacgtggggcgggcaggcagggctcctggtaacagccctgcaggccgcagtggagagcagggttccggcagggccgcccaggagctttcggaaggcccggccccggcccctttccgagcagcccgggcctccgccctgccctctgtccccaacgccgggagccgccgttcgtcctccagagccccgcccgggcgagc

SEQ ID NO: 298144 - DNA, 12134 bp, Homo sapiens
cgcgcgcgtcggcctctcggagagagggctgtggtaaaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagctgcaagatgggattcagatctgttctcaagcctgtcgttccaggacccaggagggagaagcagctgccaggggaagtctcttcgtaggcggaggtcaggagtccaagaggagtgagcagagtcacagaagcctcttaaagcctcttcttcccccatcccatcaacacggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccgtcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaatttacataaaaatgtccgtttgtgtcttttgttgtaaaaatcaagtgattttttcataaggttcttttactattggaaaagatgggcagcacgcagttttattttatttttgtaagttttttaatacatgtgaaagcaaagaatactcagcatgcctttctaagtgacgcgtttgcaccttttgttgggaagtactgtatcctgtgctgttagcattctcgataaatctctctgtgaaagtgactcaaggtctgggctttcattataagacagaagtccccctccagctcacatgacagcatggtgctgcgtttcctcattggatctggctgtccctggacacaggtagctgccttcaggcctgccacgagcggccaagggaagcctcctccatatgctggcctcgctggcccctcagcttcttccaagccagtgctctccaggcacactgctccagcgtgtgacgggaagggcctggcatgagtcagcctgcagcacaacctccctgctccagacccgtatggtaggggcaccccctaggtctggatgtgctgtggtgcttttggacacccccacccccgcaggctgtggctcctcctgtgtctcattctggccaggaccctcacgtgccctctgttgactgctaacgtggttctctgaccaggcaagggcaggctgaggggtttgcccaaagggggcccccttgttactggcttccttggctctcaggagcagcctcaccaggttggtaaggggctggaggagacaactgctcaaaggagtccagcttcacatgcacatgctagaaggtaccctcggaaggcctggccttcaaaggtagatcccagggttgaaaagtcaacttgtatgcattgagcatctcgtatgccagccctgttccgtgagctgatgggcctttgtgtgtaagtaggaccaagtgcccccgtggaggttagcatgggtgtgcagtcatttcagatacttgagttggtacatctcagtaaagtctgtcccgtgagaagccatgggtttcatggtatggttggcatcttccttgggagtggccacagtggtggtggcttcaggaaagagactccaacaggggccagctgtgggccttgggcacttctcgtttctaggaaaagtcctaagtctgtagggctaggggtggggaaccccttcgctgtcaggatcaagagggcaaggggaactgtcgctggaggagacatccagctggagaaacaaaagagtaagtctgcgttgctgcttgtggggtcttccccatctcagggcggggaccgggggtggcggtccagacaagtaatcaaggacgatgcccaggaggggacaggtacggggtggcaggagctctgccggcgggctcaggaagccttcaccacagctgcctgagctcacccttgccaaatgagggctggggcagcagcaacgcatacactcacggctgtggcgggcagcgttctcggcatatttcaggacacctaaggagactgaatggctcaaggctgctgccgtgtgcagggggctagacgtggggcgggcaggcagggctcctggtaacagccctgcaggccgcagtggagagcagggttccggcagggccgcccaggagctttcggaaggcccggccccggcccctttccgagcagcccgggcctccgccctgccctctgtccccaacgccgggagccgccgttcgtcctccagagccccgcccgggcgagc

SEQ ID NO: 298145 - DNA, 11714 bp, Homo sapiens
cgcgcgcgtcggcctctcggagagagggctgtggtaaaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccgtcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaatttacataaaaatgtccgtttgtgtcttttgttgtaaaaatcaagtgattttttcataaggttcttttactattggaaaagatgggcagcacgcagttttattttatttttgtaagttttttaatacatgtgaaagcaaagaatactcagcatgcctttctaagtgacgcgtttgcaccttttgttgggaagtactgtatcctgtgctgttagcattctcgataaatctctctgtgaaagtgactcaaggtctgggctttcattataagacagaagtccccctccagctcacatgacagcatggtgctgcgtttcctcattggatctggctgtccctggacacaggtagctgccttcaggcctgccacgagcggccaagggaagcctcctccatatgctggcctcgctggcccctcagcttcttccaagccagtgctctccaggcacactgctccagcgtgtgacgggaagggcctggcatgagtcagcctgcagcacaacctccctgctccagacccgtatggtaggggcaccccctaggtctggatgtgctgtggtgcttttggacacccccacccccgcaggctgtggctcctcctgtgtctcattctggccaggaccctcacgtgccctctgttgactgctaacgtggttctctgaccaggcaagggcaggctgaggggtttgcccaaagggggcccccttgttactggcttccttggctctcaggagcagcctcaccaggttggtaaggggctggaggagacaactgctcaaaggagtccagcttcacatgcacatgctagaaggtaccctcggaaggcctggccttcaaaggtagatcccagggttgaaaagtcaacttgtatgcattgagcatctcgtatgccagccctgttccgtgagctgatgggcctttgtgtgtaagtaggaccaagtgcccccgtggaggttagcatgggtgtgcagtcatttcagatacttgagttggtacatctcagtaaagtctgtcccgtgagaagccatgggtttcatggtatggttggcatcttccttgggagtggccacagtggtggtggcttcaggaaagagactccaacaggggccagctgtgggccttgggcacttctcgtttctaggaaaagtcctaagtctgtagggctaggggtggggaaccccttcgctgtcaggatcaagagggcaaggggaactgtcgctggaggagacatccagctggagaaacaaaagagtaagtctgcgttgctgcttgtggggtcttccccatctcagggcggggaccgggggtggcggtccagacaagtaatcaaggacgatgcccaggaggggacaggtacggggtggcaggagctctgccggcgggctcaggaagccttcaccacagctgcctgagctcacccttgccaaatgagggctggggcagcagcaacgcatacactcacggctgtggcgggcagcgttctcggcatatttcaggacacctaaggagactgaatggctcaaggctgctgccgtgtgcagggggctagacgtggggcgggcaggcagggctcctggtaacagccctgcaggccgcagtggagagcagggttccggcagggccgcccaggagctttcggaaggcccggccccggcccctttccgagcagcccgggcctccgccctgccctctgtccccaacgccgggagccgccgttcgtcctccagagccccgcccgggcgagc

SEQ ID NO: 298146 - DNA, 11529 bp, Homo sapiens
cgcgcgcgtcggcctctcggagagagggctgtggtaaaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagtaaacttagagtttcgtggcttcagggtgggagtagttggagcattggggatgtttttcttaccgacaagcacagtcaggttgaagacctaaccagggccagaagtagctttgcacttttctaaactaggctccttcaacaaggcttgctgcagatactactgaccagacaagctgttgaccaggcacctcccctcccgcccaaacctttcccccatgtggtcgttagagacagagcgacagagcagttgagaggacactcccgttttcggtgccatcagtgccccgtctacagctcccccagctccccccacctcccccactcccaaccacgttgggacagggaggtgtgaggcaggagagacagttggattctttagagaagatggatatgaccagtggctatggcctgtgcgatcccacccgtggtggctcaagtctggccccacaccagccccaatccaaaactggcaaggacgcttcacaggacaggaaagtggcacctgtctgctccagctctggcatggctaggaggggggagtcccttgaactactgggtgtagactggcctgaaccacaggagaggatggcccagggtgaggtggcatggtccattctcaagggacgtcctccaacgggtggcgctagaggccatggaggcagtaggacaaggtgcaggcaggctggcctggggtcaggccgggcagagcacagcggggtgagagggattcctaatcactcagagcagtctgtgacttagtggacaggggagggggcaaagggggaggagaagaaaatgttcttccagttactttccaattctcctttagggacagcttagaattatttgcactattgagtcttcatgttcccacttcaaaacaaacagatgctctgagagcaaactggcttgaattggtgacatttagtccctcaagccaccagatgtgacagtgttgagaactacctggatttgtatatatacctgcgcttgttttaaagtgggctcagcacatagggttcccacgaagctccgaaactctaagtgtttgctgcaattttataaggacttcctgattggtttctcttctccccttccatttctgccttttgttcatttcatcctttcacttctttcccttcctccgtcctcctccttcctagttcatcccttctcttccaggcagccgcggtgcccaaccacacttgtcggctccagtccccagaactctgcctgccctttgtcctcctgctgccagtaccagccccaccctgttttgagccctgaggaggccttgggctctgctgagtccgacctggcctgtctgtgaagagcaagagagcagcaaggtcttgctctcctaggtagccccctcttccctggtaagaaaaagcaaaaggcatttcccaccctgaacaacgagccttttcacccttctactctagagaagtggactggaggagctgggcccgatttggtagttgaggaaagcacagaggcctcctgtggcctgccagtcatcgagtggcccaacaggggctccatgccagccgaccttgacctcactcagaagtccagagtctagcgtagtgcagcagggcagtagcggtaccaatgcagaactcccaagacccgagctgggaccagtacctgggtccccagcccttcctctgctcccccttttccctcggagttcttcttgaatggcaatgttttgcttttgctcgatgcagacagggggccagaacaccacacatttcactgtctgtctggtccatagctgtggtgtaggggcttagaggcatgggcttgctgtgggtttttaattgatcagttttcatgtgggatcccatctttttaacctctgttcaggaagtccttatctagctgcatatcttcatcatattggtatatccttttctgtgtttacagagatgtctcttatatctaaatctgtccaactgagaagtaccttatcaaagtagcaaatgagacagcagtcttatgcttccagaaacacccacaggcatgtcccatgtgagctgctgccatgaactgtcaagtgtgtgttgtcttgtgtatttcagttattgtccctggcttccttactatggtgtaatcatgaaggagtgaaacatcatagaaactgtctagcacttccttgccagtctttagtgatcaggaaccatagttgacagttccaatcagtagcttaagaaaaaaccgtgtttgtctcttctggaatggttagaagtgagggagtttgccccgttctgtttgtagagtctcatagttggactttctagcatatatgtgtccatttccttatgctgtaaaagcaagtcctgcaaccaaactcccatcagcccaatccctgatccctgatcccttccacctgctctgctgatgacccccccagcttcacttctgactcttccccaggaagggaaggggggtcagaagagagggtgagtcctccagaactcttcctccaaggacagaaggctcctgcccccatagtggcctcgaactcctggcactaccaaaggacacttatccacgagagcgcagcatccgaccaggttgtcactgagaagatgtttattttggtcagttgggtttttatgtattatacttagtcaaatgtaatgtggcttctggaatcattgtccagagctgcttccccgtcacctgggcgtcatctggtcctggtaagaggagtgcgtggcccaccaggcccccctgtcacccatgacagttcattcagggccgatggggcagtcgtggttgggaacacagcatttcaagcgtcactttatttcattcgggccccacctgcagctccctcaaagaggcagttgcccagcctctttcccttccagtttattccagagctgccagtggggcctgaggctccttagggttttctctctatttccccctttcttcctcattccctcgtctttcccaaaggcatcacgagtcagtcgcctttcagcaggcagccttggcggtttatcgccctggcaggcaggggccctgcagctctcatgctgcccctgccttggggtcaggttgacaggaggttggagggaaagccttaagctgcaggattctcaccagctgtgtccggcccagttttggggtgtgacctcaatttcaattttgtctgtacttgaacattatgaagatgggggcctctttcagtgaatttgtgaacagcagaattgaccgacagctttccagtacccatggggctaggtcattaaggccacatccacagtctcccccacccttgttccagttgttagttactacctcctctcctgacaatactgtatgtcgtcgagctccccccaggtctacccctcccggccctgcctgctggtgggcttgtcatagccagtgggattgccggtcttgacagctcagtgagctggagatacttggtcacagccaggcgctagcacagctcccttctgttgatgctgtattcccatatcaaaagacacaggggacacccagaaacgccacatcccccaatccatcagtgccaaactagccaacggccccagcttctcagctcgctggatggcggaagctgctactcgtgagcgccagtgcgggtgcagacaatcttctgttgggtggcatcattccaggcccgaagcatgaacagtgcacctgggacagggagcagccccaaattgtcacctgcttctctgcccagcttttcattgctgtgacagtgatggcgaaagagggtaataaccagacacaaactgccaagttgggtggagaaaggagtttctttagctgacagaatctctgaattttaaatcacttagtaagcggctcaagcccaggagggagcagagggatacgagcggagtcccctgcgcgggaccatctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaatttacataaaaatgtccgtttgtgtcttttgttgtaaaaatcaagtgattttttcataaggttcttttactattggaaaagatgggcagcacgcagttttattttatttttgtaagttttttaatacatgtgaaagcaaagaatactcagcatgcctttctaagtgacgcgtttgcaccttttgttgggaagtactgtatcctgtgctgttagcattctcgataaatctctctgtgaaagtgactcaaggtctgggctttcattataagacagaagtccccctccagctcacatgacagcatggtgctgcgtttcctcattggatctggctgtccctggacacaggtagctgccttcaggcctgccacgagcggccaagggaagcctcctccatatgctggcctcgctggcccctcagcttcttccaagccagtgctctccaggcacactgctccagcgtgtgacgggaagggcctggcatgagtcagcctgcagcacaacctccctgctccagacccgtatggtaggggcaccccctaggtctggatgtgctgtggtgcttttggacacccccacccccgcaggctgtggctcctcctgtgtctcattctggccaggaccctcacgtgccctctgttgactgctaacgtggttctctgaccaggcaagggcaggctgaggggtttgcccaaagggggcccccttgttactggcttccttggctctcaggagcagcctcaccaggttggtaaggggctggaggagacaactgctcaaaggagtccagcttcacatgcacatgctagaaggtaccctcggaaggcctggccttcaaaggtagatcccagggttgaaaagtcaacttgtatgcattgagcatctcgtatgccagccctgttccgtgagctgatgggcctttgtgtgtaagtaggaccaagtgcccccgtggaggttagcatgggtgtgcagtcatttcagatacttgagttggtacatctcagtaaagtctgtcccgtgagaagccatgggtttcatggtatggttggcatcttccttgggagtggccacagtggtggtggcttcaggaaagagactccaacaggggccagctgtgggccttgggcacttctcgtttctaggaaaagtcctaagtctgtagggctaggggtggggaaccccttcgctgtcaggatcaagagggcaaggggaactgtcgctggaggagacatccagctggagaaacaaaagagtaagtctgcgttgctgcttgtggggtcttccccatctcagggcggggaccgggggtggcggtccagacaagtaatcaaggacgatgcccaggaggggacaggtacggggtggcaggagctctgccggcgggctcaggaagccttcaccacagctgcctgagctcacccttgccaaatgagggctggggcagcagcaacgcatacactcacggctgtggcgggcagcgttctcggcatatttcaggacacctaaggagactgaatggctcaaggctgctgccgtgtgcagggggctagacgtggggcgggcaggcagggctcctggtaacagccctgcaggccgcagtggagagcagggttccggcagggccgcccaggagctttcggaaggcccggccccggcccctttccgagcagcccgggcctccgccctgccctctgtccccaacgccgggagccgccgttcgtcctccagagccccgcccgggcgagc

SEQ ID NO: 298147 - DNA, 6281 bp, Homo sapiens
  misc_feature (25)..(25): n is a, c, g, or t
tacggctaggtacgaggctgggttngctggaattggtttagcccaagtggagcctgacagccagaactctgtgtcccccgtctaaccacagctccttttccagagcattccagtcaggctctctgggctgactgggccaggggaggttacaggtaccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaatttacataaaaatgtccgtttgtgtcttttgttgtaaaaatcaagtgattttttcataaggttcttttactattggaaaagatgggcagcacgcagttttattttatttttgtaagttttttaatacatgtgaaagcaaagaatactcagcatgcctttctaagtgacgcgtttgcaccttttgttgggaagtactgtatcctgtgctgttagcattctcgataaatctctctgtgaaagtgactcaaggtctgggctttcattataagacagaagtccccctccagctcacatgacagcatggtgctgcgtttcctcattggatctggctgtccctggacacaggtagctgccttcaggcctgccacgagcggccaagggaagcctcctccatatgctggcctcgctggcccctcagcttcttccaagccagtgctctccaggcacactgctccagcgtgtgacgggaagggcctggcatgagtcagcctgcagcacaacctccctgctccagacccgtatggtaggggcaccccctaggtctggatgtgctgtggtgcttttggacacccccacccccgcaggctgtggctcctcctgtgtctcattctggccaggaccctcacgtgccctctgttgactgctaacgtggttctctgaccaggcaagggcaggctgaggggtttgcccaaagggggcccccttgttactggcttccttggctctcaggagcagcctcaccaggttggtaaggggctggaggagacaactgctcaaaggagtccagcttcacatgcacatgctagaaggtaccctcggaaggcctggccttcaaaggtagatcccagggttgaaaagtcaacttgtatgcattgagcatctcgtatgccagccctgttccgtgagctgatgggcctttgtgtgtaagtaggaccaagtgcccccgtggaggttagcatgggtgtgcagtcatttcagatacttgagttggtacatctcagtaaagtctgtcccgtgagaagccatgggtttcatggtatggttggcatcttccttgggagtggccacagtggtggtggcttcaggaaagagactccaacaggggccagctgtgggccttgggcacttctcgtttctaggaaaagtcctaagtctgtagggctaggggtggggaaccccttcgctgtcaggatcaagagggcaaggggaactgtcgctggaggagacatccagctggagaaacaaaagagtaagtctgcgttgctgcttgtggggtcttccccatctcagggcggggaccgggggtggcggtccagacaagtaatcaaggacgatgcccaggaggggacaggtacggggtggcaggagctctgccggcgggctcaggaagccttcaccacagctgcctgagctcacccttgccaaatgagggctggggcagcagcaacgcatacactcacggctgtggcgggcagcgttctcggcatatttcaggacacctaaggagactgaatggctcaaggctgctgccgtgtgcagggggctagacgtggggcgggcaggcagggctcctggtaacagccctgcaggccgcagtggagagcagggttccggcagggccgcccaggagctttcggaaggcccggccccggcccctttccgagcagcccgggcctccgccctgccctctgtccccaacgccgggagccgccgttcgtcctccagagccccgcccgggcgagc

SEQ ID NO: 298148 - DNA, 1803 bp, Homo sapiens
cgcgcgcgtcggcctctcggagagagggctgtggtaaaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcaccaccactcagagtccccaaaggcccccgtgccactgctcccacccctgcccccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagta

SEQ ID NO: 298149 - DNA, 6215 bp, Homo sapiens
gtatccccactatctgctcatgaaacgctccttcccagtcttctcattttgacagagcctgccccagcgctgtcgtgtctggaaaacacccagttctttaagaagatctttgggcatatacatttttagcctgtgtcattgccccaaatggattcctgtttcaagttcacacctgcagattctaggacctgtgtcctagacttcagggagtcagctgtttctagagttcctaccatggagtgggtctggaggacctgcccggtgggggggcagagccctgctccctccgggtcttcctactcttctctctgctctgacgggatttgttgattctctccattttggtgtctttctcttttagatattgtatcaatctttagaaaaggcatagtctacttgttataaatcgttaggatactgcctcccccagggtctaaaattacatattagaggggaaaagctgaacactgaagtcagttctcaacaatttagaaggaaaacctagaaaacatttggcagaaaattacatttcgatgtttttgaatgaatacgagcaagcttttacaacagtgctgatctaaaaatacttagcacttggcctgagatgcctggtgagcattacaggcaaggggaatctggaggtagccgacctgaggacatggcttctgaacctgtcttttgggagtggtatggaaggtggagcgttcaccagtgacctggaaggcccagcaccaccctccttcccactcttctcatcttgacagagcctgccccagcgctgacgtgtcaggaaaacacccagggaactaggaaggcacttctgcctgaggggcagcctgccttgcccactcctgctctgctcgcctcggatcagctgagccttctgagctggcctctcactgcctccccaaggccccctgcctgccctgtcaggaggcagaaggaagcaggtgtgagggcagtgcaaggagggagcacaacccccagctcccgctccgggctccgacttgtgcacaggcagagcccagaccctggaggaaatcctacctttgaattcaagaacatttggggaatttggaaatctctttgcccccaaacccccattctgtcctacctttaatcaggtcctgctcagcagtgagagcagatgaggtgaaaaggccaagaggtttggctcctgcccactgatagcccctctccccgcagtgtttgtgtgtcaagtggcaaagctgttcttcctggtgaccctgattatatccagtaacacatagactgtgcgcataggcctgctttgtctcctctatcctgggcttttgttttgctttttagttttgcttttagtttttctgtcccttttatttaacgcaccgactagacacacaaagcagttgaatttttatatatatatctgtatattgcacaattataaactcattttgcttgtggctccacacacacaaaaaaagacctgttaaaattatacctgttgcttaattacaatatttctgataaccatagcataggacaagggaaaataaaaaaagaaaaaaaagaaaaaaaaacgacaaatctgtctgctggtcacttcttctgtccaagcagattcgtggtcttttcctcgcttctttcaagggctttcctgtgccaggtgaaggaggctccaggcagcacccaggttttgcactcttgtttctcccgtgcttgtgaaagaggtcccaaggttctgggtgcaggagcgctcccttgacctgctgaagtccggaacgtagtcggcacagcctggtcgccttccacctctgggagctggagtccactggggtggcctgactcccccagtccccttcccgtgacctggtcagggtgagcccatgtggagtcagcctcgcaggcctccctgccagtagggtccgagtgtgtttcatccttcccactctgtcgagcctgggggctggagcggagacgggaggcctggcctgtctcggaacctgtgagctgcaccaggtagaacgccagggaccccagaatcatgtgcgtcagtccaaggggtcccctccaggagtagtgaagactccagaaatgtccctttcttctcccccatcctacgagtaattgcatttgcttttgtaattcttaatgagcaatatctgctagagagtttagctgtaacagttctttttgatcatctttttttaataattagaaacaccaaaaaaatccagaaacttgttcttccaaagcagagagcattataatcaccagggccaaaagcttccctccctgctgtcattgcttcttctgaggcctgaatccaaaagaaaaacagccataggccctttcagtggccgggctacccgtgagcccttcggaggaccagggctggggcagcctctgggcccacatccggggccagctccggcgtgtgttcagtgttagcagtgggtcatgatgctctttcccacccagcctgggataggggcagaggaggcgaggaggccgttgccgctgatgtttggccgtgaacaggtgggtgtctgcgtgcgtccacgtgcgtgttttctgactgacatgaaatcgacgcccgagttagcctcacccggtgacctctagccctgcccggatggagcggggcccacccggttcagtgtttctggggagctggacagtggagtgcaaaaggcttgcagaacttgaagcctgctccttcccttgctaccacggcctcctttccgtttgatttgtcactgcttcaatcaataacagccgctccagagtcagtagtcaatgaatatatgaccaaatatcaccaggactgttactcaatgtgtgccgagcccttgcccatgctgggctcccgtgtatctggacactgtaacgtgtgctgtgtttgctccccttccccttccttctttgccctttacttgtctttctggggtttttctgtttgggtttggtttggtttttatttctccttttgtgttccaaacatgaggttctctctactggtcctcttaactgtggtgttgaggcttatatttgtgtaatttttggtgggtgaaaggaattttgctaagtaaatctcttctgtgtttgaactgaagtctgtattgtaactatgtttaaagtaattgttccagagacaaatatttctagacactttttctttacaaacaaaagcattcggagggagggggatggtgactgagatgagaggggagagctgaacagatgacccctgcccagatcagccagaagccacccaaagcagtggagcccaggagtcccactccaagccagcaagccgaatagctgatgtgttgccactttccaagtcactgcaaaaccaggttttgttccgcccagtggattcttgttttgcttcccctccccccgagattattaccaccatcccgtgcttttaaggaaaggcaagattgatgtttccttgaggggagccaggaggggatgtgtgtgtgcagagctgaagagctggggagaatggggctgggcccacccaagcaggaggctgggacgctctgctgtgggcacaggtcaggctaatgttggcagatgcagctcttcctggacaggccaggtggtgggcattctctctccaaggtgtgccccgtgggcattactgtttaagacacttccgtcacatcccaccccatcctccagggctcaacactgtgacatctctattccccaccctccccttcccagggcaataaaatgaccatggagggggcttgcactctcttggctgtcacccgatcgccagcaaaacttagatgtgagaaaaccccttcccattccatggcgaaaacatctccttagaaaagccattaccctcattaggcatggttttgggctcccaaaacacctgacagcccctccctcctctgagaggcggagagtgctgactgtagtgaccattgcatgccgggtgcagcatctggaagagctaggcagggtgtctgccccctcctgagttgaagtcatgctcccctgtgccagcccagaggccgagagctatggacagcattgccagtaacacaggccaccctgtgcagaagggagctggctccagcctggaaacctgtctgaggttgggagaggtgcacttggggcacagggagaggccgggacacacttagctggagatgtctctaaaagccctgtatcgtattcaccttcagtttttgtgttttgggacaattactttagaaaataagtaggtcgttttaaaaacaaaaattattgattgcttttttgtagtgttcagaaaaaaggttctttgtgtatagccaaatgactgaaagcactgatatatttaaaaacaaaaggcaatttattaaggaaatttgtaccatttcagtaaacctgtctgaatgtacctgtatacgtttcaaaaacaccccccccccactgaatccctgtaacctatttattatataaagagtttgccttataaatttacataaaaatgtccgtttgtgtcttttgttgtaaaaatcaagtgattttttcataaggttcttttactattggaaaagatgggcagcacgcagttttattttatttttgtaagttttttaatacatgtgaaagcaaagaatactcagcatgcctttctaagtgacgcgtttgcaccttttgttgggaagtactgtatcctgtgctgttagcattctcgataaatctctctgtgaaagtgactcaaggtctgggctttcattataagacagaagtccccctccagctcacatgacagcatggtgctgcgtttcctcattggatctggctgtccctggacacaggtagctgccttcaggcctgccacgagcggccaagggaagcctcctccatatgctggcctcgctggcccctcagcttcttccaagccagtgctctccaggcacactgctccagcgtgtgacgggaagggcctggcatgagtcagcctgcagcacaacctccctgctccagacccgtatggtaggggcaccccctaggtctggatgtgctgtggtgcttttggacacccccacccccgcaggctgtggctcctcctgtgtctcattctggccaggaccctcacgtgccctctgttgactgctaacgtggttctctgaccaggcaagggcaggctgaggggtttgcccaaagggggcccccttgttactggcttccttggctctcaggagcagcctcaccaggttggtaaggggctggaggagacaactgctcaaaggagtccagcttcacatgcacatgctagaaggtaccctcggaaggcctggccttcaaaggtagatcccagggttgaaaagtcaacttgtatgcattgagcatctcgtatgccagccctgttccgtgagctgatgggcctttgtgtgtaagtaggaccaagtgcccccgtggaggttagcatgggtgtgcagtcatttcagatacttgagttggtacatctcagtaaagtctgtcccgtgagaagccatgggtttcatggtatggttggcatcttccttgggagtggccacagtggtggtggcttcaggaaagagactccaacaggggccagctgtgggccttgggcacttctcgtttctaggaaaagtcctaagtctgtagggctaggggtggggaaccccttcgctgtcaggatcaagagggcaaggggaactgtcgctggaggagacatccagctggagaaacaaaagagtaagtctgcgttgctgcttgtggggtcttccccatctcagggcggggaccgggggtggcggtccagacaagtaatcaaggacgatgcccaggaggggacaggtacggggtggcaggagctctgccggcgggctcaggaagccttcaccacagctgcctgagctcacccttgccaaatgagggctggggcagcagcaacgcatacactcacggctgtggcgggcagcgttctcggcatatttcaggacacctaaggagactgaatggctcaaggctgctgccgtgtgcagggggctagacgtggggcgggcaggcagggctcctggtaacagccctgcaggccgcagtggagagcagggttccggcagggccgcccaggagctttcggaaggcccggccccggcccctttccgagcagcccgggcctccgccctgccctctgtccccaacgccgggagccgccgttcgtcctccagagccccgcccgggcgagc

SEQ ID NO: 298150 - DNA, 1537 bp, Homo sapiens
  misc_feature (1537)..(1537): n is a, c, g, or t
cgcgcgcgtcggcctctcggagagagggctgtggtaaaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattcccaagaaacggggccgaaagccggggagtgtggtggcagccgctgccgccgaggccaaaaagaaagccgtgaaggagtcttctatccgatctgtgcaggagaccgtactccccatcaagaagcgcaagacccgggagacggtcagcatcgaggtcaaggaagtggtgaagcccctgctggtgtccaccctcggtgagaagagcgggaaaggactgaagacctgtaagagccctgggcggaaaagcaaggagagcagccccaaggggcgcagcagcagcgcctcctcaccccccaagaaggagcaccaccaccatcacaataaagtcccaaagggcccggcaatgcaccacaccgtaccaacacatacacaggcgcaaacaagactacacagacaaaccgcgacaccagagaccccagctaaaaacagacgagcgaaagcgacaaagaaaaaaaaaacataacgagaacccaacaacagaaaagaaaaaaagaacgagctccactcagacaaccacggcacgacatacgactan

SEQ ID NO: 298151 - DNA, 1366 bp, Homo sapiens
cgcgcgcgtcggcctctcggagagagggctgtggtaaaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacctccacctgagcccgagagctccgaggaccccaccagcccccctgagccccaggacttgagcagcagcgtctgcaaagaggagaagatgcccagaggaggctcactggagagcgacggctgccccaaggagccagctaagactcagcccgcggttgccaccgccgccacggccgcagaaaagtacaaacaccgaggggagggagagcgcaaagacattgtttcatcctccatgccaaggccaaacagagaggagcctgtggacagccggacgcccgtgaccgagagagttagctgactttacacggagcggattgcaaagcaaaccaacaagaataaaggcagctgttgtctcttctccttatgggtagggctctgacaaagcttcccgattaactgaaataaaaaatatttttttttctttcagta

SEQ ID NO: 298152 - DNA, 1198 bp, Homo sapiens
cgcgcgcgtcggcctctcggagagagggctgtggtaaaagccgtccggaaaatggccgccgccgccgccgccgcgccgagcggaggaggaggaggaggcgaggaggagagactgctccataaaaatacagactcaccagttcctgctttgatgtgacatgtgactccccagaatacaccttgcttctgtagaccagctccaacaggattccatggtagctgggatgttagggctcagggaagaaaagtcagaagaccaggacctccagggcctcaaggacaaacccctcaagtttaaaaaggtgaagaaagataagaaagaagagaaagagggcaagcatgagcccgtgcagccatcagcccaccactctgctgagcccgcagaggcaggcaaagcagagacatcagaagggtcaggctccgccccggctgtgccggaagcttctgcctcccccaaacagcggcgctccatcatccgtgaccggggacccatgtatgatgaccccaccctgcctgaaggctggacacggaagcttaagcaaaggaaatctggccgctctgctgggaagtatgatgtgtatttgatcaatccccagggaaaagcctttcgctctaaagtggagttgattgcgtacttcgaaaaggtaggcgacacatccctggaccctaatgattttgacttcacggtaactgggagagggagcccctcccggcgagagcagaaaccacctaagaagcccaaatctcccaaagctccaggaactggcagaggccggggacgccccaaagggagcggcaccacgagacccaaggcggccacgtcagagggtgtgcaggtgaaaagggtcctggagaaaagtcctgggaagctccttgtcaagatgccttttcaaacttcgccagggggcaaggctgaggggggtggggccaccacatccacccaggtcatggtgatcaaacgccccggcaggaagcgaaaagctgaggccgaccctcaggccattccagaacggcgaagccggatgtgttgagcgtgcgcgaagcaaagaagcggaggcttcatcgatgggaggaacgatcccataaaggcgacggaagccatcagtagaaggagccctggtccccgaaaggagagactgtaacggggaataccagggggctcccaggcacaaagcgaggtcaaaaccaggagaaccaaa

SEQ ID NO: 298153 - DNA, 447 bp, Homo sapiens
aagtgtcccctagaggtgacaaggcttgtgatagtgttgattctaacaagcatgaatctttcctttattttagcactgtgtgttacgtgccagtaatttgcagcttatcctttgtttctagctaggtaagctgggaaatagcctagtactttgtctatgtgtttatcttcaaaatgtcccaaatagccctgggaaaaaggtcgtgcagctcaatgggggctttcaacttacaattttctttgttttaggctccgctccataaaaatacagactcaccagttcctgctttgatgtgacatgtgactccccagaatacaccttgcttctgtagaccagctccaacaggattccatggtagctgggatgttagggctcaggtaagtaaccttcctttttttttttttagtatatgtcctggtttggccatctgttttttttttttttaaa

SEQ ID NO: 298154 - DNA, 566 bp, Homo sapiens
actaccagcctccagaattgtgaggctagatcacaaaacctttgtgtttatgacatagtttatgacactatgctatgacatagcatagaaaacgaacgtatccacaacaaccatggaatggagcttctcccttgcaatggcctagaaaagacatgagaagaggatctaaaaggtcacaataatatagagccatggtaagagagaagggtggttgcagcttcaactggcattctctgtcacctttacccagttgccctagcactcagaatctatggattgatcccaaaacaatgtacgtgctgactgctgtcactgtcttaaggtagcggtaaaggaataactgaaaggaagaaatgatgacttgaaggtccatgagccaaaatatccaggagaagagtagtcagtaagaaatcagaaagccaagaacaagaagtttctgaagggaaggctagaaaagaagagtagatgtgagaagaaatattttggacactgtaaaccaacatttattcaaaagatatataatttgatcttttctgtgccaataaactaggtattcaaagtagaaa

SEQ ID NO: 298155 - DNA, 1410 bp, Homo sapiens
taattccaggactgtttactgaattgtctttctcaagtaatttgaacactcaagaattttgaacactttgctctggtataagggccatgaagttaaaccttcacattgtctgggcttgctcactgtgtgctcctaagcaaggctggttaacttctgtcagacttcggtttcttttttctttctttttctttttcttttttttttttttttttttttttgagacgcagtcttgctctgtcgccaggctggggtgcagtggcgcagtctctgctcactgcaacctccatctcccgggttcaagtgactctccttcctcagcctccccacttcagtttctttatctgtcaattgtggttagtgggctgttaatgaaaattattaggtcaaacatctactaagtatctgtcacatagtaggctcttcgtcaattggcccttttccttcccactagacaacttgagaaagcttcctcctagcctatagctactcttccgttccacttcttggtttcctgctctgattgccatgttttgttctcacagaggcaggagaggcaggtccgagaccgcggggtgacccggtccaaggcggaaaaagtgcggccgcccactgtgccagtgccgcaggtggatattgtgcctgggcggctcagtgaggccgagtggatggcgcttacagccctcgaggagggcgaggacgtcgtaggggacatcttggccgacttgctggctcgagtcatggactctgctttcaaagtctacctgactcagcaggtgggccgggatccgggtccttcagactcgtctccctctcccgcccctccctgccgacctgagatcctctctcgcctccgcagtgcattccattcaccatcagccaggcccgggaggccatgctgcagatcaccgagtggcgcttcctggcccgggacgagggagaatctgcagtagctgaggaccccacatggggtgaggacgaggagccttcggcatgcacgacggactcctgggctcagggttcagtgcccgtgctgcacgcgtccacctcggagggcctggagaacttccaaggcgaagtacactcctcaggagcctctccggactcctctgccattgctcctgctctcccctttccgacatctcactgcccgagtgcatttccccaggaccctgggggcgtggaccggatccctttaggaaggtcgtggatgggtcgaggctcccaggagcagatggaatcttgggagccttctccgcagctgagagtcacgtcggcccctcctcccacatcagagctgtttcaggaggcagggcccggaggtcctgtagaggaagcggacggccagtctagaggcctctcctcggccgggtccttgagcgcgagcttccaactgtcggtggaggaggcgcc

SEQ ID NO: 298156 - DNA, 1294 bp, Homo sapiens
tggtggtgacattgctctctgggcttttggtttgggagccacttctctgctcctccactgttgcctctggcttcccatagaggggcctgggagggttcccctggtcttaaaaggggcccaagcccccattctggcacaccccactccactgtcctggcagcagcaggtgtggccaatggaggggggtgctggcccccaggattcccccagccaaactgtctttgtcaccacgtgaggctcacacctttcatccttccccaccttccctagtccctgcactaggttggacagcccccattggctacaggaaagcgggaggggtgtgagtcccctactccctctttgcagtggccccagcccccttaccgtctgcctgggatctgagtacatattgcagtgatggagatgcagtcacctattgtccagaggcaggagaggcaggtccgagaccgcggggtgacccggtccaaggcggaaaaagtgcggccgcccactgtgccagtgccgcaggtggatattgtgcctgggcggctcagtgaggccgagtggatggcgcttacagccctcgaggagggcgaggacgtcgtaggggacatcttggccgacttgctggctcgagtcatggactctgctttcaaagtctacctgactcagcaggtgggccgggatccgggtccttcagactcgtctccctctcccgcccctccctgccgacctgagatcctctctcgcctccgcagtgcattccattcaccatcagccaggcccgggaggccatgctgcagatcaccgagtggcgcttcctggcccgggacgagggagaatctgcagtagctgaggaccccacatggggtgaggacgaggagccttcggcatgcacgacggactcctgggctcagggttcagtgcccgtgctgcacgcgtccacctcggagggcctggagaacttccaaggcgaagtacactcctcaggagcctctccggactcctctgccattgctcctgctctcccctttccgacatctcactgcccgagtgcatttccccaggaccctgggggcgtggaccggatccctttaggaaggtcgtggatgggtcgaggctcccaggagcagatggaatcttgggagccttctccgcagctgagagtcacgtcggcccctcctcccacatcagagctgtttcaggaggcagggcccggaggtcctgtagaggaagcggacggccagtctagaggcctctcctcggccgggtccttgagcgcgagcttccaactgtcggtggaggaggcgcc

SEQ ID NO: 298157 - DNA, 9118 bp, Homo sapiens
agcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagcgcgttcattcacatagctcccagttttaacatttcgccacctactgaagacatcatttgggaccaagctgatgagcccttgaagcacagcagataagagtgttgctgttgatcatctttgcctgggaagttgaatgataaagccagaagaaagcatgctttctgatcatttgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtcacagccaggggctttgggccgctgttacagtttgcctacactgccaagctgttactcagcagagaaaacatccgcgaggtcatccgctgtgctgagttcctgcgcatgcacaacctggaggactcctgcttcagcttcctgcagacccagctcctgaacagtgaggatggcctgtttgtgtgccggaaggatgctgcgtgccagcgcccacacgaggactgcgagaactctgcaggagaggaggaggatgaagaggaggagacgatggattcagagacggccaagatggcttgccccagggaccagatgcttccagagcccatcagctttgaggccgccgccatccccgtagcagagaaggaagaagccctgctgcccgagcctgacgtgcccacagacaccaaggagagctcagaaaaggacgcgttaacgcagtaccccagatacaagaaataccagcttgcatgtaccaagaatgtctataatgcatcatcacacagtacctcaggttttgcaagcacattccgggaagataactctagcaacagcctcaagccggggcttgccagggggcagattaaaagtgagccgcccagtgaagagaatgaggaagagagcatcacgctctgcctgtctggagatgagcctgacgccaaggacagagcgggggatgtcgagatggaccggaaacagcccagccctgcccctacccccacggccccagctggggccgcctgcctggagagatccaggagcgtggcctcgccctcctgcttaaggtctctgttcagcataacgaaaagtgtggagctgtctggcctgcccagtacatctcagcagcactttgccaggagtccagcctgcccttttgacaaggggatcactcagggtgaccttaaaactgactacacccctttcacagggaattatggacagccccacgtgggccagaaggaggtgtccaacttcaccatggggtcgcccctcagggggcctgggttggaggctctctgtaaacaggagggagagctggaccggaggagcgtgatcttctcctccagcgcttgtgaccaagtgagcacctcggtgcattcttattctggggtgagcagtttggacaaagacctctctgagccggtgccaaagggtctgtgggtgggagccggccagtccctccccagctcgcaggcctactcccacggtgggctgatggccgaccacttgccaggaaggatgcggcccaacaccagctgcccggtgccaatcaaagtctgccctcgctcaccccccttggagaccaggaccaggacttccagctcctgctcttcctattcctacgcggaggacgggagcgggggctcaccctgcagcctccctctctgtgagttctcctcctcgccctgttcccagggagccagattccttgccacagaacatcaggaaccaggcctgatgggagatggaatgtacaaccaagtgcggccccaaattaaatgtgagcagtcttatggaaccaactccagtgacgaatccggatcgttctcggaagcagacagtgagtcgtgtcctgtgcaggacaggggccaggaggtaaaacttccttttcctgtagatcaaatcacagatcttccaaggaacgatttccagatgatgattaaaatgcacaagctaacctcagaacagttagagtttattcatgatgtccgacggcgcagcaagaaccgcatcgcggcccagcgctgccgcaaaaggaaactggactgtattcagaatttagaatgtgaaatccgcaaattggtgtgtgagaaagagaaactgttgtcagagaggaatcaactgaaagcatgcatgggggaactgttggacaacttctcctgcctttcccaggaagtttgccgagacatccagagccccgagcagatccaggccctgcatcggtattgccctgtcctcagacccatggacttgcccacggcctccagtattaaccctgcgcccttgggtgctgagcagaacattgcggcctcccaatgcgcagtgggggaaaacgtgccctgctgcttggagccaggcgcggctccccccggacccccctgggcacccagcaacacctccgagaattgtacctctgggaggagactagaaggcactgacccgggaaccttctcagagagaggacctcctcttgaacccaggagccaaacagtgaccgtggacttctgccaggaaatgactgataagtgtacaactgacgaacagcccaggaaagattatacctagtgactcggctctgcctcccagtccgcacacctctcccatccaggcgttcttcagtcagcctgtggcactgttcatctgctgtcccgaagaaaccgagaacacatttggtgcacactacagcggtcttagcagcaatactgttccgaagtatcctctcctcttctcgagcaggagtgatagttaccttcacaatggtgctaccccttgcccaggcaaggaaagacagcagtgatgacactgtctgtctgtggctcaatttcagtcttcacagggatagactacaacacctctaggccccaaccacggattttttttctcagtggcccatgtcacaaaccctatctcaggaatttcttctgaatgttcaatttttttcattgaagacagcttctatacacatcaaagttttatagctagactgtacatattatatataatatatatataaaaaatatatatatatatatatatccatatgcaaaagtcctgcatgcctcaactttctcatcctaaaactggaaacttatttctcatttagaaacaggttccaacattcctcttcttttgtctctgatgctagaactagtttggtaactgttaacatggtcatttttcttgcttcacagttcaattttcaattcgtacttatttatggacaaaattcagtgttggaagctttttcccaaggttttatttcagatttctttttcgtttggtttggttttggcacctccaagtggtgtcatttgagcattgtaggtttgttttttgtttgtttggggggttttgtttgtttttgtttttgtttttgttttccttgcagatactgtacagtaatggtcaactttgccacttgcactgagttttgggtcaaacctattttcttaaatgaagttgtaacttcggtataactcaagtatactgtatattctttgcttttagttaaaaaagtaaaacattttagctaattaaaaagcactcaggtgataattatgtaggaaaaacaatcttgccaaataatgaattcatcctaggatgtgtagacaataatctgcttgaatatttttatatttcacctcctccccacctttccctaagcaaagtttaaacgcagatagagagttcagagttgatgctggatgttcagattcctaagtggggagagagtttggacatctcactcaaaagtacatcagaaaaacaggaatccgtgattttataccagaactcagcaggcattggctcctagaaatcaagttagaaagttttcacccagggagtaagtcccattcatttcaacacgtcctgaggcctcggcttgctcttggaagtggtgtgcagtaggacctgctcccctgaaggacggggccaaccagccactggctttcctgcccaggcttggcctcccaggacatctggcctgaggggatttgaatcacagccccgaaggtcctgccttcaccccattgggagagagcagggcatcctggcatctgcgatccatccctgacacaggctgacacattctttctcctttccttctccaaaggcttggagttttcttctgaggtttttctgccagtgtcttgtctgaaggcagacttcattctgaggctttggacaagctatcaccgggaaccctccctgtccccttcccgaatcacacacataccctaccctcacctgatgataattttctcttcttgctgcaaaactggttggcttgcaacccagagagagcagcttcccttggctctggggccgtgttggccccagccacgtttacaggaaggtgtgccccagaggaggaggaatcagctccctcgctccagtggccttgggtccgggtctcactgagcagcccgagggccactccagcccggctggggaagagagtcctgaacggtttgatgtggggatggggtggtgggcagtggggaatagatggttgactttgtttctttatttgtgccattgtttggacaatattaaagctgcatgtaaaaggggaaattagtatatgatgtaggctaaaagtgaaatcatagtaacatatgttttagtattattaacttttttctgtacaaatattagcactaaatgtttaaatatgtatgaatgccagaaatttgtcagttcatgcagtaggataaaaaaaaaaaaaaaaaaaaaaaggcttttctttttaaacagttccacttttaaaacctgcctctgggtttttgttttttcttgtttgtgtgtgtgtgtgtgtgtgtgtgtgtgtgtgtgtgtgtgtgtgtgtgtctgaaacagatcttgataaagctctgtgttggagctgctggtttttgttatggttgttggaatttcttggcctactaggacagttctgtgcttcaccatgaggtttgcctttgtggaaaactggtgacagtgagaatataaactcaatgtgaatcacgtgatacttcggcaggcgtgtgttacagtggagtcagctgacagtattttgctttttaactctattgttgcctttccaagtgacctctcctcttcttttaaaaaaagaacactttctgctcatatcataaccaggtccaacccagcttcttggcatgaggtttaccctggtaacaactcatgtgcaactggtagtcttgaccacattccatccatttcctcaggtttctgtggttcagtagcccagacctgtttggcagccatttctagcaggggcggggcctctttatttctctccaccctaactcagacctcaccttcctcccacccacccctgccttgcttttcttcctcttcccccaacctaacttctgccatgggaactggttaaaaacactgctctaaaaaccatcttccaatttcatagagatttctcacaagttatttcattcataatccaccatgaacagtgactagcttcgtgcagttgttcatgtgatgtgtgtgtgtcttttcctattcagaactatgtgcttgtcaaaattatttctgggttgattcaaagggaggacttgctggggaccagaatccaaacggcctcaagtggaattttaaaacctagcctgtctcttttccctgggatccctctgtcaaccccacgccttttaggaaaaagaaaagtgagtgaacagcaaggaagagtgtttgcacagtacagtaacatttggttgttcttaaggctcttttcttacaaaaataagagaccctccaaccacgggctgtttaggaggatgcctgcttgggtctccaaatggctggggtaggaatggttgttggggcagagccagtggaggtgagtgaccctgagactaatgaacatcccacctaaatccagtcctccccttggatctgcctttgtcctgcttgtgtatccaggcaacctcttttcaagttggtcaggctttggacaggtgagtgatttgctgtatgtgtttgtttctctgcgttacctgggggtgccttgattaaaatcgaactttattacatactgattctggaacaaaacagttagaaaaactttaaaaaaaaaaaaaaccgacaaagttacgaggccatcctgctatttatcttctgagttcccagcaatgactcaggcatcagagatgatgctgcagtggaaaacctgactctgtgtgtctgcaactgaatgttgtgcgagtaatttattaactgtctttctaaaggtttgctgcttttaagatgcactataattcgggatgtaatccttacattgcttttccaaggaagggaacaaaagtctagtgattagtatgccaactgccactactccttcaaaaggagccaggaccagcgacaagactcatgagaggactggctaaagtgaagtgtgcacagtgtgaagtttaatgctgttgtcaagaggcctaaacccacattttctcttttaatattttatgattgccatcaaagaagaagaaaaagaaggaacagacaaaggtttgaaaatgataagcctgttaagacaccaaaaactcctgtcccgtgaagctgcttgacatcctgtggagtagcataatcctctcaaaatgaggaagagctgcctgcaaagctttctcaagtccctatttggctacctacttctctacattatgccccatttaaactaggagctgtcttagaaatgacttcaaactgcttcactattgcttacagtttaggaggagtctcagatccagaaggagcaagaatcaagtttggtcctcaaatgactgtaaatagactaaagaacaaggtgttttttgtttttgtttttgttttctaagaataaagctgttcgttgtatcatgagttagtgtttcttccccaaactgaagactgtgttggaagtgcaatttctggtgagtcagtccacaatacaatgccctgtgtggagttggtattcatacaggaaatctgtgtgcacgaggcattgtgtgttgaaagtgtatgtttatagtactgcctgagccatctcatgaccccagcgtccaaaaccgatgctgtagaacagaacatatctgtacacaaatagtgtgtgcaaatagcatttgtacatagaaaagtctcattgtggcagattgagcataaattattcaactgacggtgcaaaaacattacttgcaaagaaaagtttatagtattttcctacactccaccctgggagatgatatttctatcaaatgaatatcagtgcattttaaatgtaatatgaaaacgatgctgccattttgtgaagaatacccacttggttgcagaggccaactttcatagctttgatttaatgttgtgacacggtgtatgcattttgctgtcaagcaatggataaacagctctgactttcattctcattccagtttattgacctcagataaaacactggcccttcttagaagcagaagtgtgcaccaagaccattcatttcaggtagactcacattcagtgccaagtgctcccatgggaataatcagacgcatatgttgcgaaagagtgaagggacttggacaaagaggggttttcctacagatggatgctcagtcttctaccaaaacatgtttggaggcagaactatgacctccccttaagtcctaacaatgtattttgtgtgtgcaaatcctgggatgcccgtttcacgctctgacataaagacatggcacctctagtgagtgatcaggaagattccatatgcatttgggagcttcaggtgcttgttagacacagtgagccattcaaggcaagcaccacctttgctagtgaggccaagagagcctgtgacaatttgacaatttgttccagaaccagtctgatgcaagtgcacctctaatatatgccttacaaactccagaggccatattcaaaacagggtcttctcagtgtatgcaaggggctgcagcccctcttctcttcctccccaggttgaacaatacggacagttttcacacatatctacctgtataaccctctgtacctctcataactggtcaacgactgtaacaggttacatcaggtgtttttctacatactttttacacagattctatgcgattaatgtaatttaattcaatgcatcattttattgtactagttcttaggcttgtccttatttttttctaagtgattgtggtttttctcgtggtttttattgtaaaaaatgaaaggctgttgatgcttattctctgtaactaagaatttttaccttttgggggaaaaaagcattgctatgaactaatgaattgaaacttcatttactcattgtaaatacactattgtgcaaaaaaagttttcactcaattgaattgctagtgttaactgaattttgtctagacaccatttctgttgatgaaataaagacatatcattatgcattgtaaactgaaaatctct

SEQ ID NO: 298158 - DNA, 541 bp, Homo sapiens
agcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagcgcgttcattcacatagctcccagttttaacatttcgccacctactgaagacatcatttgggaccaagctgatgagcccttgaagcacagcagtgcagctgtctgcttcagaaagtgagggctccaggaatgaggagaatcttcaagaacttcctcgcactgtgacatgtctgatcccttgctcccatccctgcagcatgaacaagaaaccgctcctgcctcaactccaagggccagagcgagttggcacaccctccaagaggagcacctcgcttct

SEQ ID NO: 298159 - DNA, 419 bp, Homo sapiens
  misc_feature (341)..(341): n is a, c, g, or t
agcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagtgcagctgtctgcttcagaaagtgagggctccaggaatgaggagaatcttcaagaacttccctccgccatctgctgnagcatggttcctggataccctttggcttccccattcccctggcaagcatggaaacataggtttggggtggttcttttg

SEQ ID NO: 298160 - DNA, 7374 bp, Homo sapiens
agcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagtgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtcacagccaggggctttgggccgctgttacagtttgcctacactgccaagctgttactcagcagagaaaacatccgcgaggtcatccgctgtgctgagttcctgcgcatgcacaacctggaggactcctgcttcagcttcctgcagacccagctcctgaacagtgaggatggcctgtttgtgtgccggaaggatgctgcgtgccagcgcccacacgaggactgcgagaactctgcaggagaggaggaggatgaagaggaggagacgatggattcagagacggccaagatggcttgccccagggaccagatgcttccagagcccatcagctttgaggccgccgccatccccgtagcagagaaggaagaagccctgctgcccgagcctgacgtgcccacagacaccaaggagagctcagaaaaggacgcgttaacgcagtaccccagatacaagaaataccagcttgcatgtaccaagaatgtctataatgcatcatcacacagtacctcaggttttgcaagcacattccgggaagataactctagcaacagcctcaagccggggcttgccagggggcagattaaaagtgagccgcccagtgaagagaatgaggaagagagcatcacgctctgcctgtctggagatgagcctgacgccaaggacagagcgggggatgtcgagatggaccggaaacagcccagccctgcccctacccccacggccccagctggggccgcctgcctggagagatccaggagcgtggcctcgccctcctgcttaaggtctctgttcagcataacgaaaagtgtggagctgtctggcctgcccagtacatctcagcagcactttgccaggagtccagcctgcccttttgacaaggggatcactcagggtgaccttaaaactgactacacccctttcacagggaattatggacagccccacgtgggccagaaggaggtgtccaacttcaccatggggtcgcccctcagggggcctgggttggaggctctctgtaaacaggagggagagctggaccggaggagcgtgatcttctcctccagcgcttgtgaccaagtgagcacctcggtgcattcttattctggggtgagcagtttggacaaagacctctctgagccggtgccaaagggtctgtgggtgggagccggccagtccctccccagctcgcaggcctactcccacggtgggctgatggccgaccacttgccaggaaggatgcggcccaacaccagctgcccggtgccaatcaaagtctgccctcgctcaccccccttggagaccaggaccaggacttccagctcctgctcttcctattcctacgcggaggacgggagcgggggctcaccctgcagcctccctctctgtgagttctcctcctcgccctgttcccagggagccagattccttgccacagaacatcaggaaccaggcctgatgggagatggaatgtacaaccaagtgcggccccaaattaaatgtgagcagtcttatggaaccaactccagtgacgaatccggatcgttctcggaagcagacagtgagtcgtgtcctgtgcaggacaggggccaggaggtaaaacttccttttcctgtagatcaaatcacagatcttccaaggaacgatttccagatgatgattaaaatgcacaagctaacctcagaacagttagagtttattcatgatgtccgacggcgcagcaagaaccgcatcgcggcccagcgctgccgcaaaaggaaactggactgtattcagaatttagaatgtgaaatccgcaaattggtgtgtgagaaagagaaactgttgtcagagaggaatcaactgaaagcatgcatgggggaactgttggacaacttctcctgcctttcccaggaagtttgccgagacatccagagccccgagcagatccaggccctgcatcggtattgccctgtcctcagacccatggacttgcccacggcctccagtattaaccctgcgcccttgggtgctgagcagaacattgcggcctcccaatgcgcagtgggggaaaacgtgccctgctgcttggagccaggcgcggctccccccggacccccctgggcacccagcaacacctccgagaattgtacctctgggaggagactagaaggcactgacccgggaaccttctcagagagaggacctcctcttgaacccaggagccaaacagtgaccgtggacttctgccaggaaatgactgataagtgtacaactgacgaacagcccaggaaagattatacctagtgactcggctctgcctcccagtccgcacacctctcccatccaggcgttcttcagtcagcctgtggcactgttcatctgctgtcccgaagaaaccgagaacacatttggtgcacactacagcggtcttagcagcaatactgttccgaagtatcctctcctcttctcgagcaggagtgatagttaccttcacaatggtgctaccccttgcccaggcaaggaaagacagcagtgatgacactgtctgtctgtggctcaatttcagtcttcacagggatagactacaacacctctaggccccaaccacggattttttttctcagtggcccatgtcacaaaccctatctcaggaatttcttctgaatgttcaatttttttcattgaagacagcttctatacacatcaaagttttatagctagactgtacatattatatataatatatatataaaaaatatatatatatatatatatccatatgcaaaagtcctgcatgcctcaactttctcatcctaaaactggaaacttatttctcatttagaaacaggttccaacattcctcttcttttgtctctgatgctagaactagtttggtaactgttaacatggtcatttttcttgcttcacagttcaattttcaattcgtacttatttatggacaaaattcagtgttggaagctttttcccaaggttttatttcagatttctttttcgtttggtttggttttggcacctccaagtggtgtcatttgagcattgtaggtttgttttttgtttgtttggggggttttgtttgtttttgtttttgtttttgttttccttgcagatactgtacagtaatggtcaactttgccacttgcactgagttttgggtcaaacctattttcttaaatgaagttgtaacttcggtataactcaagtatactgtatattctttgcttttagttaaaaaagtaaaacattttagctaattaaaaagcactcaggtgataattatgtaggaaaaacaatcttgccaaataatgaattcatcctaggatgtgtagacaataatctgcttgaatatttttatatttcacctcctccccacctttccctaagcaaagtttaaacgcagatagagagttcagagttgatgctggatgttcagattcctaagtggggagagagtttggacatctcactcaaaagtacatcagaaaaacaggaatccgtgattttataccagaactcagcaggcattggctcctagaaatcaagttagaaagttttcacccagggagtaagtcccattcatttcaacacgtcctgaggcctcggcttgctcttggaagtggtgtgcagtaggacctgctcccctgaaggacggggccaaccagccactggctttcctgcccaggcttggcctcccaggacatctggcctgaggggatttgaatcacagccccgaaggtcctgccttcaccccattgggagagagcagggcatcctggcatctgcgatccatccctgacacaggctgacacattctttctcctttccttctccaaaggcttggagttttcttctgaggtttttctgccagtgtcttgtctgaaggcagacttcattctgaggctttggacaagctatcaccgggaaccctccctgtccccttcccgaatcacacacataccctaccctcacctgatgataattttctcttcttgctgcaaaactggttggcttgcaacccagagagagcagcttcccttggctctggggccgtgttggccccagccacgtttacaggaaggtgtgccccagaggaggaggaatcagctccctcgctccagtggccttgggtccgggtctcactgagcagcccgagggccactccagcccggctggggaagagagtcctgaacggtttgatgtggggatggggtggtgggcagtggggaatagatggttgactttgtttctttatttgtgccattgtttggacaatattaaagctgcatgtaaaaggggaaattagtatatgatgtaggctaaaagtgaaatcatagtaacatatgttttagtattattaacttttttctgtacaaatattagcactaaatgtttaaatatgtatgaatgccagaaatttgtcagttcatgcagtaggataaaaaaaaaaaaaaaaaaaaaaaggcttttctttttaaacagttccacttttaaaacctgcctctgggtttttgttttttcttgtttgtgtgtgtgtgtgtgtgtgtgtgtgtgtgtgtgtgtgtgtgtgtgtgtctgaaacagatcttgataaagctctgtgttggagctgctggtttttgttatggttgttggaatttcttggcctactaggacagttctgtgcttcaccatgaggtttgcctttgtggaaaactggtgacagtgagaatataaactcaatgtgaatcacgtgatacttcggcaggcgtgtgttacagtggagtcagctgacagtattttgctttttaactctattgttgcctttccaagtgacctctcctcttcttttaaaaaaagaacactttctgctcatatcataaccaggtccaacccagcttcttggcatgaggtttaccctggtaacaactcatgtgcaactggtagtcttgaccacattccatccatttcctcaggtttctgtggttcagtagcccagacctgtttggcagccatttctagcaggggcggggcctctttatttctctccaccctaactcagacctcaccttcctcccacccacccctgccttgcttttcttcctcttcccccaacctaacttctgccatgggaactggttaaaaacactgctctaaaaaccatcttccaatttcatagagatttctcacaagttatttcattcataatccaccatgaacagtgactagcttcgtgcagttgttcatgtgatgtgtgtgtgtcttttcctattcagaactatgtgcttgtcaaaattatttctgggttgattcaaagggaggacttgctggggaccagaatccaaacggcctcaagtggaattttaaaacctagcctgtctcttttccctgggatccctctgtcaaccccacgccttttaggaaaaagaaaagtgagtgaacagcaaggaagagtgtttgcacagtacagtaacatttggttgttcttaaggctcttttcttacaaaaataagagaccctccaaccacgggctgtttaggaggatgcctgcttgggtctccaaatggctggggtaggaatggttgttggggcagagccagtggaggtgagtgaccctgagactaatgaacatcccacctaaatccagtcctccccttggatctgcctttgtcctgcttgtgtatccaggcaacctcttttcaagttggtcaggctttggacaggtgagtgatttgctgtatgtgtttgtttctctgcgttacctgggggtgccttgattaaaatcgaactttattacatactgattctggaacaaaacagttagaaaaactttaaaaaaaaaaaaaaccgacaaagttacgaggccatcctgctatttatcttctgagttcccagcaatgactcaggcatcagagatgatgctgcagtggaaaacctgactctgtgtgtctgcaactgaatgttgtgcgagtaatttattaactgtctttctaaaggtttgctgcttttaagatgcactataattcgggatgtaatccttacattgcttttccaaggaagggaacaaaagtctagtgattagtatgccaactgccactactccttcaaaaggagccaggaccagcgacaagactcatgagaggactggctaaagtgaagtgtgcacagtgtgaagtttaatgctgttgtcaagaggcctaaacccacattttctcttttaatattttatgattgccatcaaagaagaagaaaaagaaggaacagacaaaggtttgaaaatgataagcctgttaagacaccaaaaactcctgtcccgtgaagctgcttgacatcctgtggagtagcataatcctctcaaaatgaggaagagctgcctgcaaagctttctcaagtccctatttggctacctacttctctacattatgccccatttaaactaggagctgtcttagaaatgacttcaaactgcttcactattgcttacagtttaggaggagtctcagatccagaaggagcaagaatcaagtttggtcctcaaatgactgtaaatagactaaagaacaaggtgttttttgtttttgtttttgttttctaagaataaagctgttcgttgtatcatg

SEQ ID NO: 298161 - DNA, 7467 bp, Homo sapiens
agcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagcgcgttcattcacatagctcccagttttaacatttcgccacctactgaagacatcatttgggaccaagctgatgagcccttgaagcacagcagtgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtcacagccaggggctttgggccgctgttacagtttgcctacactgccaagctgttactcagcagagaaaacatccgcgaggtcatccgctgtgctgagttcctgcgcatgcacaacctggaggactcctgcttcagcttcctgcagacccagctcctgaacagtgaggatggcctgtttgtgtgccggaaggatgctgcgtgccagcgcccacacgaggactgcgagaactctgcaggagaggaggaggatgaagaggaggagacgatggattcagagacggccaagatggcttgccccagggaccagatgcttccagagcccatcagctttgaggccgccgccatccccgtagcagagaaggaagaagccctgctgcccgagcctgacgtgcccacagacaccaaggagagctcagaaaaggacgcgttaacgcagtaccccagatacaagaaataccagcttgcatgtaccaagaatgtctataatgcatcatcacacagtacctcaggttttgcaagcacattccgggaagataactctagcaacagcctcaagccggggcttgccagggggcagattaaaagtgagccgcccagtgaagagaatgaggaagagagcatcacgctctgcctgtctggagatgagcctgacgccaaggacagagcgggggatgtcgagatggaccggaaacagcccagccctgcccctacccccacggccccagctggggccgcctgcctggagagatccaggagcgtggcctcgccctcctgcttaaggtctctgttcagcataacgaaaagtgtggagctgtctggcctgcccagtacatctcagcagcactttgccaggagtccagcctgcccttttgacaaggggatcactcagggtgaccttaaaactgactacacccctttcacagggaattatggacagccccacgtgggccagaaggaggtgtccaacttcaccatggggtcgcccctcagggggcctgggttggaggctctctgtaaacaggagggagagctggaccggaggagcgtgatcttctcctccagcgcttgtgaccaagtgagcacctcggtgcattcttattctggggtgagcagtttggacaaagacctctctgagccggtgccaaagggtctgtgggtgggagccggccagtccctccccagctcgcaggcctactcccacggtgggctgatggccgaccacttgccaggaaggatgcggcccaacaccagctgcccggtgccaatcaaagtctgccctcgctcaccccccttggagaccaggaccaggacttccagctcctgctcttcctattcctacgcggaggacgggagcgggggctcaccctgcagcctccctctctgtgagttctcctcctcgccctgttcccagggagccagattccttgccacagaacatcaggaaccaggcctgatgggagatggaatgtacaaccaagtgcggccccaaattaaatgtgagcagtcttatggaaccaactccagtgacgaatccggatcgttctcggaagcagacagtgagtcgtgtcctgtgcaggacaggggccaggaggtaaaacttccttttcctgtagatcaaatcacagatcttccaaggaacgatttccagatgatgattaaaatgcacaagctaacctcagaacagttagagtttattcatgatgtccgacggcgcagcaagaaccgcatcgcggcccagcgctgccgcaaaaggaaactggactgtattcagaatttagaatgtgaaatccgcaaattggtgtgtgagaaagagaaactgttgtcagagaggaatcaactgaaagcatgcatgggggaactgttggacaacttctcctgcctttcccaggaagtttgccgagacatccagagccccgagcagatccaggccctgcatcggtattgccctgtcctcagacccatggacttgcccacggcctccagtattaaccctgcgcccttgggtgctgagcagaacattgcggcctcccaatgcgcagtgggggaaaacgtgccctgctgcttggagccaggcgcggctccccccggacccccctgggcacccagcaacacctccgagaattgtacctctgggaggagactagaaggcactgacccgggaaccttctcagagagaggacctcctcttgaacccaggagccaaacagtgaccgtggacttctgccaggaaatgactgataagtgtacaactgacgaacagcccaggaaagattatacctagtgactcggctctgcctcccagtccgcacacctctcccatccaggcgttcttcagtcagcctgtggcactgttcatctgctgtcccgaagaaaccgagaacacatttggtgcacactacagcggtcttagcagcaatactgttccgaagtatcctctcctcttctcgagcaggagtgatagttaccttcacaatggtgctaccccttgcccaggcaaggaaagacagcagtgatgacactgtctgtctgtggctcaatttcagtcttcacagggatagactacaacacctctaggccccaaccacggattttttttctcagtggcccatgtcacaaaccctatctcaggaatttcttctgaatgttcaatttttttcattgaagacagcttctatacacatcaaagttttatagctagactgtacatattatatataatatatatataaaaaatatatatatatatatatatccatatgcaaaagtcctgcatgcctcaactttctcatcctaaaactggaaacttatttctcatttagaaacaggttccaacattcctcttcttttgtctctgatgctagaactagtttggtaactgttaacatggtcatttttcttgcttcacagttcaattttcaattcgtacttatttatggacaaaattcagtgttggaagctttttcccaaggttttatttcagatttctttttcgtttggtttggttttggcacctccaagtggtgtcatttgagcattgtaggtttgttttttgtttgtttggggggttttgtttgtttttgtttttgtttttgttttccttgcagatactgtacagtaatggtcaactttgccacttgcactgagttttgggtcaaacctattttcttaaatgaagttgtaacttcggtataactcaagtatactgtatattctttgcttttagttaaaaaagtaaaacattttagctaattaaaaagcactcaggtgataattatgtaggaaaaacaatcttgccaaataatgaattcatcctaggatgtgtagacaataatctgcttgaatatttttatatttcacctcctccccacctttccctaagcaaagtttaaacgcagatagagagttcagagttgatgctggatgttcagattcctaagtggggagagagtttggacatctcactcaaaagtacatcagaaaaacaggaatccgtgattttataccagaactcagcaggcattggctcctagaaatcaagttagaaagttttcacccagggagtaagtcccattcatttcaacacgtcctgaggcctcggcttgctcttggaagtggtgtgcagtaggacctgctcccctgaaggacggggccaaccagccactggctttcctgcccaggcttggcctcccaggacatctggcctgaggggatttgaatcacagccccgaaggtcctgccttcaccccattgggagagagcagggcatcctggcatctgcgatccatccctgacacaggctgacacattctttctcctttccttctccaaaggcttggagttttcttctgaggtttttctgccagtgtcttgtctgaaggcagacttcattctgaggctttggacaagctatcaccgggaaccctccctgtccccttcccgaatcacacacataccctaccctcacctgatgataattttctcttcttgctgcaaaactggttggcttgcaacccagagagagcagcttcccttggctctggggccgtgttggccccagccacgtttacaggaaggtgtgccccagaggaggaggaatcagctccctcgctccagtggccttgggtccgggtctcactgagcagcccgagggccactccagcccggctggggaagagagtcctgaacggtttgatgtggggatggggtggtgggcagtggggaatagatggttgactttgtttctttatttgtgccattgtttggacaatattaaagctgcatgtaaaaggggaaattagtatatgatgtaggctaaaagtgaaatcatagtaacatatgttttagtattattaacttttttctgtacaaatattagcactaaatgtttaaatatgtatgaatgccagaaatttgtcagttcatgcagtaggataaaaaaaaaaaaaaaaaaaaaaaggcttttctttttaaacagttccacttttaaaacctgcctctgggtttttgttttttcttgtttgtgtgtgtgtgtgtgtgtgtgtgtgtgtgtgtgtgtgtgtgtgtgtgtctgaaacagatcttgataaagctctgtgttggagctgctggtttttgttatggttgttggaatttcttggcctactaggacagttctgtgcttcaccatgaggtttgcctttgtggaaaactggtgacagtgagaatataaactcaatgtgaatcacgtgatacttcggcaggcgtgtgttacagtggagtcagctgacagtattttgctttttaactctattgttgcctttccaagtgacctctcctcttcttttaaaaaaagaacactttctgctcatatcataaccaggtccaacccagcttcttggcatgaggtttaccctggtaacaactcatgtgcaactggtagtcttgaccacattccatccatttcctcaggtttctgtggttcagtagcccagacctgtttggcagccatttctagcaggggcggggcctctttatttctctccaccctaactcagacctcaccttcctcccacccacccctgccttgcttttcttcctcttcccccaacctaacttctgccatgggaactggttaaaaacactgctctaaaaaccatcttccaatttcatagagatttctcacaagttatttcattcataatccaccatgaacagtgactagcttcgtgcagttgttcatgtgatgtgtgtgtgtcttttcctattcagaactatgtgcttgtcaaaattatttctgggttgattcaaagggaggacttgctggggaccagaatccaaacggcctcaagtggaattttaaaacctagcctgtctcttttccctgggatccctctgtcaaccccacgccttttaggaaaaagaaaagtgagtgaacagcaaggaagagtgtttgcacagtacagtaacatttggttgttcttaaggctcttttcttacaaaaataagagaccctccaaccacgggctgtttaggaggatgcctgcttgggtctccaaatggctggggtaggaatggttgttggggcagagccagtggaggtgagtgaccctgagactaatgaacatcccacctaaatccagtcctccccttggatctgcctttgtcctgcttgtgtatccaggcaacctcttttcaagttggtcaggctttggacaggtgagtgatttgctgtatgtgtttgtttctctgcgttacctgggggtgccttgattaaaatcgaactttattacatactgattctggaacaaaacagttagaaaaactttaaaaaaaaaaaaaaccgacaaagttacgaggccatcctgctatttatcttctgagttcccagcaatgactcaggcatcagagatgatgctgcagtggaaaacctgactctgtgtgtctgcaactgaatgttgtgcgagtaatttattaactgtctttctaaaggtttgctgcttttaagatgcactataattcgggatgtaatccttacattgcttttccaaggaagggaacaaaagtctagtgattagtatgccaactgccactactccttcaaaaggagccaggaccagcgacaagactcatgagaggactggctaaagtgaagtgtgcacagtgtgaagtttaatgctgttgtcaagaggcctaaacccacattttctcttttaatattttatgattgccatcaaagaagaagaaaaagaaggaacagacaaaggtttgaaaatgataagcctgttaagacaccaaaaactcctgtcccgtgaagctgcttgacatcctgtggagtagcataatcctctcaaaatgaggaagagctgcctgcaaagctttctcaagtccctatttggctacctacttctctacattatgccccatttaaactaggagctgtcttagaaatgacttcaaactgcttcactattgcttacagtttaggaggagtctcagatccagaaggagcaagaatcaagtttggtcctcaaatgactgtaaatagactaaagaacaaggtgttttttgtttttgtttttgttttctaagaataaagctgttcgttgtatcatg

SEQ ID NO: 298162 - DNA, 7452 bp, Homo sapiens
agcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagataagagtgttgctgttgatcatctttgcctgggaagttgaatgataaagccagaagaaagcatgctttctgatcatttgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtcacagccaggggctttgggccgctgttacagtttgcctacactgccaagctgttactcagcagagaaaacatccgcgaggtcatccgctgtgctgagttcctgcgcatgcacaacctggaggactcctgcttcagcttcctgcagacccagctcctgaacagtgaggatggcctgtttgtgtgccggaaggatgctgcgtgccagcgcccacacgaggactgcgagaactctgcaggagaggaggaggatgaagaggaggagacgatggattcagagacggccaagatggcttgccccagggaccagatgcttccagagcccatcagctttgaggccgccgccatccccgtagcagagaaggaagaagccctgctgcccgagcctgacgtgcccacagacaccaaggagagctcagaaaaggacgcgttaacgcagtaccccagatacaagaaataccagcttgcatgtaccaagaatgtctataatgcatcatcacacagtacctcaggttttgcaagcacattccgggaagataactctagcaacagcctcaagccggggcttgccagggggcagattaaaagtgagccgcccagtgaagagaatgaggaagagagcatcacgctctgcctgtctggagatgagcctgacgccaaggacagagcgggggatgtcgagatggaccggaaacagcccagccctgcccctacccccacggccccagctggggccgcctgcctggagagatccaggagcgtggcctcgccctcctgcttaaggtctctgttcagcataacgaaaagtgtggagctgtctggcctgcccagtacatctcagcagcactttgccaggagtccagcctgcccttttgacaaggggatcactcagggtgaccttaaaactgactacacccctttcacagggaattatggacagccccacgtgggccagaaggaggtgtccaacttcaccatggggtcgcccctcagggggcctgggttggaggctctctgtaaacaggagggagagctggaccggaggagcgtgatcttctcctccagcgcttgtgaccaagtgagcacctcggtgcattcttattctggggtgagcagtttggacaaagacctctctgagccggtgccaaagggtctgtgggtgggagccggccagtccctccccagctcgcaggcctactcccacggtgggctgatggccgaccacttgccaggaaggatgcggcccaacaccagctgcccggtgccaatcaaagtctgccctcgctcaccccccttggagaccaggaccaggacttccagctcctgctcttcctattcctacgcggaggacgggagcgggggctcaccctgcagcctccctctctgtgagttctcctcctcgccctgttcccagggagccagattccttgccacagaacatcaggaaccaggcctgatgggagatggaatgtacaaccaagtgcggccccaaattaaatgtgagcagtcttatggaaccaactccagtgacgaatccggatcgttctcggaagcagacagtgagtcgtgtcctgtgcaggacaggggccaggaggtaaaacttccttttcctgtagatcaaatcacagatcttccaaggaacgatttccagatgatgattaaaatgcacaagctaacctcagaacagttagagtttattcatgatgtccgacggcgcagcaagaaccgcatcgcggcccagcgctgccgcaaaaggaaactggactgtattcagaatttagaatgtgaaatccgcaaattggtgtgtgagaaagagaaactgttgtcagagaggaatcaactgaaagcatgcatgggggaactgttggacaacttctcctgcctttcccaggaagtttgccgagacatccagagccccgagcagatccaggccctgcatcggtattgccctgtcctcagacccatggacttgcccacggcctccagtattaaccctgcgcccttgggtgctgagcagaacattgcggcctcccaatgcgcagtgggggaaaacgtgccctgctgcttggagccaggcgcggctccccccggacccccctgggcacccagcaacacctccgagaattgtacctctgggaggagactagaaggcactgacccgggaaccttctcagagagaggacctcctcttgaacccaggagccaaacagtgaccgtggacttctgccaggaaatgactgataagtgtacaactgacgaacagcccaggaaagattatacctagtgactcggctctgcctcccagtccgcacacctctcccatccaggcgttcttcagtcagcctgtggcactgttcatctgctgtcccgaagaaaccgagaacacatttggtgcacactacagcggtcttagcagcaatactgttccgaagtatcctctcctcttctcgagcaggagtgatagttaccttcacaatggtgctaccccttgcccaggcaaggaaagacagcagtgatgacactgtctgtctgtggctcaatttcagtcttcacagggatagactacaacacctctaggccccaaccacggattttttttctcagtggcccatgtcacaaaccctatctcaggaatttcttctgaatgttcaatttttttcattgaagacagcttctatacacatcaaagttttatagctagactgtacatattatatataatatatatataaaaaatatatatatatatatatatccatatgcaaaagtcctgcatgcctcaactttctcatcctaaaactggaaacttatttctcatttagaaacaggttccaacattcctcttcttttgtctctgatgctagaactagtttggtaactgttaacatggtcatttttcttgcttcacagttcaattttcaattcgtacttatttatggacaaaattcagtgttggaagctttttcccaaggttttatttcagatttctttttcgtttggtttggttttggcacctccaagtggtgtcatttgagcattgtaggtttgttttttgtttgtttggggggttttgtttgtttttgtttttgtttttgttttccttgcagatactgtacagtaatggtcaactttgccacttgcactgagttttgggtcaaacctattttcttaaatgaagttgtaacttcggtataactcaagtatactgtatattctttgcttttagttaaaaaagtaaaacattttagctaattaaaaagcactcaggtgataattatgtaggaaaaacaatcttgccaaataatgaattcatcctaggatgtgtagacaataatctgcttgaatatttttatatttcacctcctccccacctttccctaagcaaagtttaaacgcagatagagagttcagagttgatgctggatgttcagattcctaagtggggagagagtttggacatctcactcaaaagtacatcagaaaaacaggaatccgtgattttataccagaactcagcaggcattggctcctagaaatcaagttagaaagttttcacccagggagtaagtcccattcatttcaacacgtcctgaggcctcggcttgctcttggaagtggtgtgcagtaggacctgctcccctgaaggacggggccaaccagccactggctttcctgcccaggcttggcctcccaggacatctggcctgaggggatttgaatcacagccccgaaggtcctgccttcaccccattgggagagagcagggcatcctggcatctgcgatccatccctgacacaggctgacacattctttctcctttccttctccaaaggcttggagttttcttctgaggtttttctgccagtgtcttgtctgaaggcagacttcattctgaggctttggacaagctatcaccgggaaccctccctgtccccttcccgaatcacacacataccctaccctcacctgatgataattttctcttcttgctgcaaaactggttggcttgcaacccagagagagcagcttcccttggctctggggccgtgttggccccagccacgtttacaggaaggtgtgccccagaggaggaggaatcagctccctcgctccagtggccttgggtccgggtctcactgagcagcccgagggccactccagcccggctggggaagagagtcctgaacggtttgatgtggggatggggtggtgggcagtggggaatagatggttgactttgtttctttatttgtgccattgtttggacaatattaaagctgcatgtaaaaggggaaattagtatatgatgtaggctaaaagtgaaatcatagtaacatatgttttagtattattaacttttttctgtacaaatattagcactaaatgtttaaatatgtatgaatgccagaaatttgtcagttcatgcagtaggataaaaaaaaaaaaaaaaaaaaaaaggcttttctttttaaacagttccacttttaaaacctgcctctgggtttttgttttttcttgtttgtgtgtgtgtgtgtgtgtgtgtgtgtgtgtgtgtgtgtgtgtgtgtgtctgaaacagatcttgataaagctctgtgttggagctgctggtttttgttatggttgttggaatttcttggcctactaggacagttctgtgcttcaccatgaggtttgcctttgtggaaaactggtgacagtgagaatataaactcaatgtgaatcacgtgatacttcggcaggcgtgtgttacagtggagtcagctgacagtattttgctttttaactctattgttgcctttccaagtgacctctcctcttcttttaaaaaaagaacactttctgctcatatcataaccaggtccaacccagcttcttggcatgaggtttaccctggtaacaactcatgtgcaactggtagtcttgaccacattccatccatttcctcaggtttctgtggttcagtagcccagacctgtttggcagccatttctagcaggggcggggcctctttatttctctccaccctaactcagacctcaccttcctcccacccacccctgccttgcttttcttcctcttcccccaacctaacttctgccatgggaactggttaaaaacactgctctaaaaaccatcttccaatttcatagagatttctcacaagttatttcattcataatccaccatgaacagtgactagcttcgtgcagttgttcatgtgatgtgtgtgtgtcttttcctattcagaactatgtgcttgtcaaaattatttctgggttgattcaaagggaggacttgctggggaccagaatccaaacggcctcaagtggaattttaaaacctagcctgtctcttttccctgggatccctctgtcaaccccacgccttttaggaaaaagaaaagtgagtgaacagcaaggaagagtgtttgcacagtacagtaacatttggttgttcttaaggctcttttcttacaaaaataagagaccctccaaccacgggctgtttaggaggatgcctgcttgggtctccaaatggctggggtaggaatggttgttggggcagagccagtggaggtgagtgaccctgagactaatgaacatcccacctaaatccagtcctccccttggatctgcctttgtcctgcttgtgtatccaggcaacctcttttcaagttggtcaggctttggacaggtgagtgatttgctgtatgtgtttgtttctctgcgttacctgggggtgccttgattaaaatcgaactttattacatactgattctggaacaaaacagttagaaaaactttaaaaaaaaaaaaaaccgacaaagttacgaggccatcctgctatttatcttctgagttcccagcaatgactcaggcatcagagatgatgctgcagtggaaaacctgactctgtgtgtctgcaactgaatgttgtgcgagtaatttattaactgtctttctaaaggtttgctgcttttaagatgcactataattcgggatgtaatccttacattgcttttccaaggaagggaacaaaagtctagtgattagtatgccaactgccactactccttcaaaaggagccaggaccagcgacaagactcatgagaggactggctaaagtgaagtgtgcacagtgtgaagtttaatgctgttgtcaagaggcctaaacccacattttctcttttaatattttatgattgccatcaaagaagaagaaaaagaaggaacagacaaaggtttgaaaatgataagcctgttaagacaccaaaaactcctgtcccgtgaagctgcttgacatcctgtggagtagcataatcctctcaaaatgaggaagagctgcctgcaaagctttctcaagtccctatttggctacctacttctctacattatgccccatttaaactaggagctgtcttagaaatgacttcaaactgcttcactattgcttacagtttaggaggagtctcagatccagaaggagcaagaatcaagtttggtcctcaaatgactgtaaatagactaaagaacaaggtgttttttgtttttgtttttgttttctaagaataaagctgttcgttgtatcatg

SEQ ID NO: 298163 - DNA, 7379 bp, Homo sapiens
caccaaacaaagaccacactgttgacagcgttgggttccagtagcggtaaactaccaaggggctggtttacagaaaatgagtttgctctgtgatgtcatacaagtttgctttgtcctgacgccaacatgacactgaggcagcagaggagggagaacaggaaaattggaaccgtactcttagttaatggtttccagagattatttagcaggacttgaacagagggaggaaaatattgtgaaggattgctgcgaggtgtaccataattgcgtgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtcacagccaggggctttgggccgctgttacagtttgcctacactgccaagctgttactcagcagagaaaacatccgcgaggtcatccgctgtgctgagttcctgcgcatgcacaacctggaggactcctgcttcagcttcctgcagacccagctcctgaacagtgaggatggcctgtttgtgtgccggaaggatgctgcgtgccagcgcccacacgaggactgcgagaactctgcaggagaggaggaggatgaagaggaggagacgatggattcagagacggccaagatggcttgccccagggaccagatgcttccagagcccatcagctttgaggccgccgccatccccgtagcagagaaggaagaagccctgctgcccgagcctgacgtgcccacagacaccaaggagagctcagaaaaggacgcgttaacgcagtaccccagatacaagaaataccagcttgcatgtaccaagaatgtctataatgcatcatcacacagtacctcaggttttgcaagcacattccgggaagataactctagcaacagcctcaagccggggcttgccagggggcagattaaaagtgagccgcccagtgaagagaatgaggaagagagcatcacgctctgcctgtctggagatgagcctgacgccaaggacagagcgggggatgtcgagatggaccggaaacagcccagccctgcccctacccccacggccccagctggggccgcctgcctggagagatccaggagcgtggcctcgccctcctgcttaaggtctctgttcagcataacgaaaagtgtggagctgtctggcctgcccagtacatctcagcagcactttgccaggagtccagcctgcccttttgacaaggggatcactcagggtgaccttaaaactgactacacccctttcacagggaattatggacagccccacgtgggccagaaggaggtgtccaacttcaccatggggtcgcccctcagggggcctgggttggaggctctctgtaaacaggagggagagctggaccggaggagcgtgatcttctcctccagcgcttgtgaccaagtgagcacctcggtgcattcttattctggggtgagcagtttggacaaagacctctctgagccggtgccaaagggtctgtgggtgggagccggccagtccctccccagctcgcaggcctactcccacggtgggctgatggccgaccacttgccaggaaggatgcggcccaacaccagctgcccggtgccaatcaaagtctgccctcgctcaccccccttggagaccaggaccaggacttccagctcctgctcttcctattcctacgcggaggacgggagcgggggctcaccctgcagcctccctctctgtgagttctcctcctcgccctgttcccagggagccagattccttgccacagaacatcaggaaccaggcctgatgggagatggaatgtacaaccaagtgcggccccaaattaaatgtgagcagtcttatggaaccaactccagtgacgaatccggatcgttctcggaagcagacagtgagtcgtgtcctgtgcaggacaggggccaggaggtaaaacttccttttcctgtagatcaaatcacagatcttccaaggaacgatttccagatgatgattaaaatgcacaagctaacctcagaacagttagagtttattcatgatgtccgacggcgcagcaagaaccgcatcgcggcccagcgctgccgcaaaaggaaactggactgtattcagaatttagaatgtgaaatccgcaaattggtgtgtgagaaagagaaactgttgtcagagaggaatcaactgaaagcatgcatgggggaactgttggacaacttctcctgcctttcccaggaagtttgccgagacatccagagccccgagcagatccaggccctgcatcggtattgccctgtcctcagacccatggacttgcccacggcctccagtattaaccctgcgcccttgggtgctgagcagaacattgcggcctcccaatgcgcagtgggggaaaacgtgccctgctgcttggagccaggcgcggctccccccggacccccctgggcacccagcaacacctccgagaattgtacctctgggaggagactagaaggcactgacccgggaaccttctcagagagaggacctcctcttgaacccaggagccaaacagtgaccgtggacttctgccaggaaatgactgataagtgtacaactgacgaacagcccaggaaagattatacctagtgactcggctctgcctcccagtccgcacacctctcccatccaggcgttcttcagtcagcctgtggcactgttcatctgctgtcccgaagaaaccgagaacacatttggtgcacactacagcggtcttagcagcaatactgttccgaagtatcctctcctcttctcgagcaggagtgatagttaccttcacaatggtgctaccccttgcccaggcaaggaaagacagcagtgatgacactgtctgtctgtggctcaatttcagtcttcacagggatagactacaacacctctaggccccaaccacggattttttttctcagtggcccatgtcacaaaccctatctcaggaatttcttctgaatgttcaatttttttcattgaagacagcttctatacacatcaaagttttatagctagactgtacatattatatataatatatatataaaaaatatatatatatatatatatccatatgcaaaagtcctgcatgcctcaactttctcatcctaaaactggaaacttatttctcatttagaaacaggttccaacattcctcttcttttgtctctgatgctagaactagtttggtaactgttaacatggtcatttttcttgcttcacagttcaattttcaattcgtacttatttatggacaaaattcagtgttggaagctttttcccaaggttttatttcagatttctttttcgtttggtttggttttggcacctccaagtggtgtcatttgagcattgtaggtttgttttttgtttgtttggggggttttgtttgtttttgtttttgtttttgttttccttgcagatactgtacagtaatggtcaactttgccacttgcactgagttttgggtcaaacctattttcttaaatgaagttgtaacttcggtataactcaagtatactgtatattctttgcttttagttaaaaaagtaaaacattttagctaattaaaaagcactcaggtgataattatgtaggaaaaacaatcttgccaaataatgaattcatcctaggatgtgtagacaataatctgcttgaatatttttatatttcacctcctccccacctttccctaagcaaagtttaaacgcagatagagagttcagagttgatgctggatgttcagattcctaagtggggagagagtttggacatctcactcaaaagtacatcagaaaaacaggaatccgtgattttataccagaactcagcaggcattggctcctagaaatcaagttagaaagttttcacccagggagtaagtcccattcatttcaacacgtcctgaggcctcggcttgctcttggaagtggtgtgcagtaggacctgctcccctgaaggacggggccaaccagccactggctttcctgcccaggcttggcctcccaggacatctggcctgaggggatttgaatcacagccccgaaggtcctgccttcaccccattgggagagagcagggcatcctggcatctgcgatccatccctgacacaggctgacacattctttctcctttccttctccaaaggcttggagttttcttctgaggtttttctgccagtgtcttgtctgaaggcagacttcattctgaggctttggacaagctatcaccgggaaccctccctgtccccttcccgaatcacacacataccctaccctcacctgatgataattttctcttcttgctgcaaaactggttggcttgcaacccagagagagcagcttcccttggctctggggccgtgttggccccagccacgtttacaggaaggtgtgccccagaggaggaggaatcagctccctcgctccagtggccttgggtccgggtctcactgagcagcccgagggccactccagcccggctggggaagagagtcctgaacggtttgatgtggggatggggtggtgggcagtggggaatagatggttgactttgtttctttatttgtgccattgtttggacaatattaaagctgcatgtaaaaggggaaattagtatatgatgtaggctaaaagtgaaatcatagtaacatatgttttagtattattaacttttttctgtacaaatattagcactaaatgtttaaatatgtatgaatgccagaaatttgtcagttcatgcagtaggataaaaaaaaaaaaaaaaaaaaaaaggcttttctttttaaacagttccacttttaaaacctgcctctgggtttttgttttttcttgtttgtgtgtgtgtgtgtgtgtgtgtgtgtgtgtgtgtgtgtgtgtgtgtgtctgaaacagatcttgataaagctctgtgttggagctgctggtttttgttatggttgttggaatttcttggcctactaggacagttctgtgcttcaccatgaggtttgcctttgtggaaaactggtgacagtgagaatataaactcaatgtgaatcacgtgatacttcggcaggcgtgtgttacagtggagtcagctgacagtattttgctttttaactctattgttgcctttccaagtgacctctcctcttcttttaaaaaaagaacactttctgctcatatcataaccaggtccaacccagcttcttggcatgaggtttaccctggtaacaactcatgtgcaactggtagtcttgaccacattccatccatttcctcaggtttctgtggttcagtagcccagacctgtttggcagccatttctagcaggggcggggcctctttatttctctccaccctaactcagacctcaccttcctcccacccacccctgccttgcttttcttcctcttcccccaacctaacttctgccatgggaactggttaaaaacactgctctaaaaaccatcttccaatttcatagagatttctcacaagttatttcattcataatccaccatgaacagtgactagcttcgtgcagttgttcatgtgatgtgtgtgtgtcttttcctattcagaactatgtgcttgtcaaaattatttctgggttgattcaaagggaggacttgctggggaccagaatccaaacggcctcaagtggaattttaaaacctagcctgtctcttttccctgggatccctctgtcaaccccacgccttttaggaaaaagaaaagtgagtgaacagcaaggaagagtgtttgcacagtacagtaacatttggttgttcttaaggctcttttcttacaaaaataagagaccctccaaccacgggctgtttaggaggatgcctgcttgggtctccaaatggctggggtaggaatggttgttggggcagagccagtggaggtgagtgaccctgagactaatgaacatcccacctaaatccagtcctccccttggatctgcctttgtcctgcttgtgtatccaggcaacctcttttcaagttggtcaggctttggacaggtgagtgatttgctgtatgtgtttgtttctctgcgttacctgggggtgccttgattaaaatcgaactttattacatactgattctggaacaaaacagttagaaaaactttaaaaaaaaaaaaaaccgacaaagttacgaggccatcctgctatttatcttctgagttcccagcaatgactcaggcatcagagatgatgctgcagtggaaaacctgactctgtgtgtctgcaactgaatgttgtgcgagtaatttattaactgtctttctaaaggtttgctgcttttaagatgcactataattcgggatgtaatccttacattgcttttccaaggaagggaacaaaagtctagtgattagtatgccaactgccactactccttcaaaaggagccaggaccagcgacaagactcatgagaggactggctaaagtgaagtgtgcacagtgtgaagtttaatgctgttgtcaagaggcctaaacccacattttctcttttaatattttatgattgccatcaaagaagaagaaaaagaaggaacagacaaaggtttgaaaatgataagcctgttaagacaccaaaaactcctgtcccgtgaagctgcttgacatcctgtggagtagcataatcctctcaaaatgaggaagagctgcctgcaaagctttctcaagtccctatttggctacctacttctctacattatgccccatttaaactaggagctgtcttagaaatgacttcaaactgcttcactattgcttacagtttaggaggagtctcagatccagaaggagcaagaatcaagtttggtcctcaaatgactgtaaatagactaaagaacaaggtgttttttgtttttgtttttgttttctaagaataaagctgttcgttgtatcatg

SEQ ID NO: 298164 - DNA, 1342 bp, Homo sapiens
agcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagtgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggaggtacagtaatttggtttgtgtgattgttaatgaatgtttattgacttacagaaaactggctgactaggagctagaagatgtactaggtgccatgtccccactcaggagttgatgtccaagtcacatgttaggtctgtggcatagtcagtttctatttgatacacttaaagtctcagaggcacagaatgtgaatatctttcttgaagggaactgaacctcacctgtggctcagtcacttgtagtttctagttcacttacccttcaggttttgagtggttcagcctaagtttggcacagtcctagatgtgggatctgaatcattgctatgatttctgtctttcagatggtgtaaggatcactagatttcccttgagagtaaaagatcgaaagcattcacagcaccttctttgcttgggggaaaaataaaagcaactagtaattttcaccattaattcagtaagattctaagaagtgtaaacttgcttttctcaccgttgttgaaaacagcccactcaggtttcttaatcacatcagtgaatacggttattttggcactttggg

SEQ ID NO: 298165 - DNA, 999 bp, Homo sapiens
agcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgagctttcggtgacccacgaactgcccacctcgccggctgccgggagggggctgcgagccgggaagacgcggggaagaggaggcggaaaaggacgcaaagttctccggcgagtgcagctgtctgcttcagaaagtgagggctccaggaatgaggagaatcttcaagaacttcctcgcactgtgacatgtctgatcccttgctcccatccctgcagcatgaacaaggtggacactcactgacctgtcacaaggttgccccacaaaactttggggtccatgtctgaatggattgccagagccttctcatctctcccttcgcccagttccctgcatcctaagactcgaaggcagcacaggacctggaaaaattacatggtgtgaacggcatgtctgtggatgagaagcctgactcccccatgtatgtgtatgagtccacagtccactgcaccaacatcctcctgggcctcaatgaccagcggaaaaaggatattctctgtgacgtgactttgatcgtggagaggaaggagttccgggcccaccgggctgtgctggccgcatgcagtgaatatttttggcaggcgctggttggacagacaaaaaatgatttggtggtcagcttgcctgaggagatggtgtaaggatcactagatttcccttgagagtaaaagatcgaaagcattcacagcaccttctttgcttgggggaaaaataaaagcaactagtaattttcaccattaattcagtaagattctaagaagtgtaaacttgcttttctcaccgttgttgaaaacagcccactcaggtttcttaatcacatcagtgaatacggttattttggcactttggg

SEQ ID NO: 298166 - DNA, 2341 bp, Homo sapiens
cgggctcacaactgtctgctgcgcccgaaaaacaagtcggtgcgctggggacccggggccggggccgccttactccggcctagccccgcggccctcggtgcgggctccagggcatgctcgggaccccccgcggctccagcccagacgccccggcctcaggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatta

SEQ ID NO: 298167 - DNA, 390 bp, Homo sapiens
gaacaaactcttgttctctgtggttggggaaaaggtgtgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatta

SEQ ID NO: 298168 - DNA, 309 bp, Homo sapiens
cgggctcacaactgtctgctgcgcccgaaaaacaagtcggtgcgctggggacccggggccggggccgccttactccggcctagccccgcggccctcggtgcgggctccagggcatgctcgggaccccccgcggctccagcccagacgccccggcctcaggtctcggcccccgcttggggccccggccgtgcggccggagggagcggccggatggagcggaggatgaaagccggatacttggaccagcaagtgccctacaccttcagcagcgtgagcgccgcgccggcctccacgcccgccccgccccgc

SEQ ID NO: 298169 - DNA, 2209 bp, Homo sapiens
tgcgaacgcagccccctcccccaccaggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatta

SEQ ID NO: 298170 - DNA, 2266 bp, Homo sapiens
acacacacacgttcttatgtaaccgagcccgggtaaagcagggctgcagaaagcagaaacggcgagcccggctcctgggagcaggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatta

SEQ ID NO: 298171 - DNA, 2169 bp, Homo sapiens
tgggctgccccgcccctgagtcacccgaggaccccaacctcgtcccccagactaagcgcctcagggtgactcgcgggcattctccccgcttctcgcagaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatta

SEQ ID NO: 298172 - DNA, 2230 bp, Homo sapiens
cgggctcacaactgtctgctgcgcccgaaaaacaagtcggtgcgctggggacccggggccggggccgccttactccggcctagccccgcggccctcggtgcgggctccagggcatgctcgggaccccccgcggctccagcccagacgccccggcctcagaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatta

SEQ ID NO: 298173 - DNA, 1583 bp, Homo sapiens
cggcacgaggcttgcccagcccccgctgctgccttccatggcctcagccgcagccctcaagttgaggaggggttccagcatcacactccctctgggtgaactttccctgggattttgtggttggcaggcaacctgggcaaagaacagtcaccaggaagcaggctggaaggaagaaattcttgaatgtggataggacttcctcctcccctgccctcgagctccaccccaagccacttctcacatcaccccttcttcccccacagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatta

SEQ ID NO: 298174 - DNA, 2151 bp, Homo sapiens
tgggctgccccgcccctgagtcacccgaggaccccaacctcgtcccccagactaagcgcctcagggtgactcgcgggcattctccccgcttctcgcagaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatta

SEQ ID NO: 298175 - DNA, 2888 bp, Homo sapiens
tgcgaacgcagccccctcccccaccaggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccattaaaacaacaaacaacaacaacacacaccgcgaggacatccccaggacgggcagcgcaccacgcggaaacgaaagggccaatgggcacacaaagcggcccccggaccaagctgcttggccaccacacgcgcgacaatcgtgaccggaacccacctataccggaagcccgcaacactcgcgacacagcccaggtcaaccctgcgcatacaggcacgcggaaaccgcacacacaccaaacacaaccgcaccaaaacgacacaaccaacacactacagggcacccaccaaaaacggcgaaaagacaacagcggcccgggagcaccaccccacaccccactgaaccccacaacacaagaccagcgaccacgcaggcgacaagacaaatcgagcgaccacaaaccgcgccacgagagacaggcggagcacaccaagcggccggaagagacgaggcgggggaggagaagacgcgacggcggcaccggcggccggggcaaggagggagaggggccgagcacagcagcaacgcaagcagaggccaaaacgaagcagcagcggcggaagcacgcagcgagcaggcgccacgagcagaaaaaagcgggggcgcagcagcacagagcggaacacgacggcagggcagacagccagagaagcgggaaagagagagcgaccggcggcgcagtgc

SEQ ID NO: 298176 - DNA, 1094 bp, Homo sapiens
tatttctggggacaacgcacgtgaaatttatccatattatgacccatggatgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacagatgtctctggggcagatccccactgtcctaccagttgccctagcccagactctgagctgctcaccggagtcattgggaaggaaaagtggagaaatggcaagtctagagtctcagaaactcccctgggggtttcacctgggccctggaggaattcagctcagcttcttcctaggtccaagccccccacaccttttccccaaccacagagaacaagagtttgttctgttctgggggacagagaaggcgcttcccaacttcatactggcaggagggtgaggaggttcactgagctccccagatctcccactgcggggagacagaagcctggactctgccccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatta

SEQ ID NO: 298177 - DNA, 1867 bp, Homo sapiens
tgcgaacgcagccccctcccccaccaggtctcggcccccgcttggggccccggccgtgcggccggagggagcggccggatggagcggaggatgaaagccggatacttggaccagcaagtgccctacaccttcagcagcaaatcgcccggaaatgggagcttgcgcgaagcgctgatcggcccgctggggaagctcatggacccgggctccctgccgcccctcgactctgaagatctcttccaggatctaagtcacttccaggagacgtggctcgctgaagctcaggtaccagacagtgatgagcagtttgttcctgatttccattcagaaaacctagctttccacagccccaccaccaggatcaagaaggagccccagagtccccgcacagacccggccctgtcctgcagcaggaagccgccactcccctaccaccatggcgagcagtgcctttactccagtgcctatgacccccccagacaaatcgccatcaagtcccctgcccctggtgcccttggacagtcgcccctacagccctttccccgggcagagcaacggaatttcctgagatcctctggcacctcccagccccaccctggccatgggtacctcggggaacatagctccgtcttccagcagcccctggacatttgccactccttcacatctcagggagggggccgggaacccctcccagccccctaccaacaccagctgtcggagccctgcccaccctatccccagcagagctttaagcaagaataccatgatcccctgtatgaacaggcgggccagccagccgtggaccagggtggggtcaatgggcacaggtacccaggggcgggggtggtgatcaaacaggaacagacggacttcgcctacgactcagatgtcaccgggtgcgcatcaatgtacctccacacagagggcttctctgggccctctccaggtgacggggccatgggctatggctatgagaaacctctgcgaccattcccagatgatgtctgcgttgtccctgagaaatttgaaggagacatcaagcaggaaggggtcggtgcatttcgagaggggccgccctaccagcgccggggtgccctgcagctgtggcaatttctggtggccttgctggatgacccaacaaatgcccatttcattgcctggacgggccggggaatggagttcaagctcattgagcctgaggaggtcgccaggctctggggcatccagaagaaccggccagccatgaattacgacaagctgagccgctcgctccgatactattatgagaaaggcatcatgcagaaggtggctggtgagcgttacgtgtacaagtttgtgtgtgagcccgaggccctcttctctttggccttcccggacaatcagcgtccagctctcaaggctgagtttgaccggcctgtcagtgaggaggacacagtccctttgtcccacttggatgagagccccgcctacctcccagagctggctggccccgcccagccatttggccccaagggtggctactcttactagcccccagcggctgttccccctgccgcaggtgggtgctgccctgtgtacatataaatgaatctggtgttggggaaaccttcatctgaaacccacgctgtggccctggagggtcccggtttgtcagttcttggtgctctgtgttcccagaggcaggcggaggttgaagaaaggaacctgggatgaggggtgctgggtataagcagagagggatgggttcctgctccaagggaccctttgcctttcttctgccctttcctaggcccaggcctgggtttgtacttccacctccaccacatctgccagaccttaataaaggcccccacttctcccatta

SEQ ID NO: 298178 - DNA, 270 bp, Homo sapiens
agccaaaatgttcttgtctcactgcgggtctcagaaaattgatacccagagagggaaggaggctgtaccagtcacccagctggtcctcaaagctcagaaggtatcagaagccctgcctgcctcttgtgtgacaggctctggccttgctctgtcccctccacccccacagtagctttccacagccccaccaccaggatcaagaaggagccccagagtccccgcacagacccggccctgtcctgcagcaggaagccgccactcccctaccac

SEQ ID NO: 298179 - DNA, 1336 bp, Homo sapiens
gcttactagtctcggggtccccgagtgcggaaaccctacctttgcggtggggtctggacgcccgagagcccttctcagcaaagtccctgaagaggagcgaggcggctccgaggaaccgcggaggaagtgaagccagtcccgccactcttcagaccggccctccacctcggccaccgtcaccacagagctgaaggaggcctagagagccgcgcgtgccgcgccaccgagaccggaaggaggcggcacagacctggaggacgaccgcggagctgagcgcttagagccgccgaaccatagagatcggaaataggagcgagcggcagcgccggaaaggaggccaagagcgcgggcggcgaggcaagatggcggcaaccaagaggaaacggcgtggaggctttgcagttcaggcgaagaagccaaaaagaaacgaaatagatgcggagccgccagctaagcggcacgccacagcagaggaggtggaggaagaagagagggaccggatcccaggccccgtttgcaagggaaagtggaaaaataaggaacggattctcatcttttcttccagaggaataaattttagaacaagacatttaatgcaggacttgagaatgttgatgcctcattctaaagcagatactaaaatggatcgtaaggataagctatttgtgattaacgaggtttgtgaaatgaagaactgtaataaatgcatctattttgaagctaagaaaaaacaggatctctatatgtggctttcaaattcacctcacggaccatctgctaaattccttgttcaaaatattcataccctcgctgaactgaagatgactggaaactgtttgaaaggttctcggccccttttgtcttttgaccctgcttttgatgaattaccacattatgctttgttaaaagaactcttaattcagatctttagtacaccacggtatcatcccaaaagccaaccatttgtggaccacgtgtttactttcaccattttggataataggatatggtttcggaactttcagatcatagaagaagatgctgctcttgtagaaataggacctcgttttgtcttaaatctcataaagattttccagggaagttttggaggaccaactttatatgaaaatcctcactaccagtcaccaaacatgcatcggcgtgtcataagatccatcacagctgcaaaatacagagagaaacagcaagtgaaagatgtgcaaaaactgagaaagaaagagccgaagactcttcttccacatgatcccactgcagatgtttttgtaacaccagctgaggagaaaccaatagaaatacagtgggtaaaaccagagcc

SEQ ID NO: 298180 - DNA, 2526 bp, Homo sapiens
gcttactagtctcggggtccccgagtgcggaaaccctacctttgcggtggggtctggacgcccgagagcccttctcagcaaagtccctgaagaggagcgaggcggctccgaggaaccgcggaggaagtgaagccagtcccgccactcttcagaccggccctccacctcggccaccgtcaccacagagctgaaggaggcctagagagccgcgcgtgccgcgccaccgagaccggaaggaggcggcacagacctggaggacgaccgcggagctgagcgcttagagccgccgaaccatagagatcggaaataggagcgagcggcagcgccggaaaggaggccaagagcgcgggcggcgaggcaagatggcggcaaccaagaggaaacggcgtggaggctttgcagttcaggcgaagaagccaaaaagaaacgaaatagatgcggagccgccagctaagcggcacgccacagcagaggaggtggaggaagaagagagggaccggatcccaggccccgtttgcaagggaaagtggaaaaataaggaacggattctcatcttttcttccagaggaataaattttagaacaagacatttaatgcaggacttgagaatgttgatgcctcattctaaagcagatactaaaatggatcgtaaggataagctatttgtgattaacgaggtttgtgaaatgaagaactgtaataaatgcatctattttgaagctaagaaaaaacaggatctctatatgtggtaagagaatgtattaagattttggttaaactcatttaagtggatttgttctttgtaccttttatgttatagactcctagtgtttcatgttaagggttgagaatgaagcaaacttttgatttcacgaaacttgatacctttaaagaaaattaaatgtataaatattataagcatattatttatggtgaataggtggtaagcattgactacatttgctaattagtggaaaaagcttactccatatctttcaggctttcaaattcacctcacggaccatctgctaaattccttgttcaaaatagtaagttgactcaataaatttttttagatgaggaaattaaaagtaatcttttgaaatagttgtgcaaaagttacaactatttttgtttttgttgtaatttttctagttcataccctcgctgaactgaagatgactggaaactgtttgaaaggttctcggccccttttgtcttttgaccctgtaagtttctcattcagtgtatgaggtctaattttcttatctggcatggttgtttttagtagatatagttgtgttattcaatttagtttcacccccaccttggttttatggattatcaattctttcaggtacatttataatgaggttatagccaagttatagaaacaaatgagcaaacagttttaaacaaggcagtctactgttaaataatatgcttaccttatttttataggcttttgatgaattaccacattatgctttgttaaaagaactcttaattcaggtaaatatctttaaaattagctatccaaaatatacatgatatatcttggaataaggaactaacatacacttttttaactagatctttagtacaccacggtatcatcccaaaagccaaccatttgtggaccacgtgtttactttcaccattttggataataggatatggtttcggaactttcagatcatagaagaagatgctgctcttgtagaaataggacctcgttttgtcttaaatctcataaagattttccagggaagttttggaggaccaactttatatgaaaatcctcactaccagtcaccaaacatggtaagcggttgtgtcattcagtagtcttcaatgtaccagaaccctttggccaaaatgattctgtgaagtaattgctgttttattacctgtgaaactgaatttggtttttgctgcatagaaacttggaaattactcccttttttcatgacactggctgaaaggatatatggttcataactgaaagtctttgccttatataaaatgtttatttttatttcaaaagcatctaatcttttttttttttttttagcatcggcgtgtcataagatccatcacagctgcaaaatacagagagaaacagcaagtgaaagatgtgcaaaaactgagaaagaaagagccgaagactcttcttccacatgatcccactgcagatgtttttgtaacaccagctgaggagaaaccaatagaaatacagtgggtaaaaccagagccaaaagttgatttgaaagcaagaaagaaacggatttacaaaaggcaaagaaaaatgaaacagaggatggacagtgggaaaacaaaataagtcaatggaaacctgatttgtttttcagttactttatatttattttgtattcaatgtgtaaatacttttattatctaatactatcttacgtctaattagtgtagcatttacaagaaagaaaaattaagatcttaaaatcagtgattatctttttctaaataaaatatcaccagaattcatca

SEQ ID NO: 298181 - DNA, 1508 bp, Homo sapiens
  misc_feature (1288)..(1288): n is a, c, g, or t
  misc_feature (1502)..(1503): n is a, c, g, or t
gcttactagtctcggggtccccgagtgcggaaaccctacctttgcggtggggtctggacgcccgagagcccttctcagcaaagtccctgaagaggagcgaggcggctccgaggaaccgcggaggaagtgaagccagtcccgccactcttcagaccggccctccacctcggccaccgtcaccacagagctgaaggaggcctagagagccgcgcgtgccgcgccaccgagaccggaaggaggcggcacagacctggaggacgaccgcggagctgagcgcttagagccgccgaaccatagagatcggaaataggagcgagcggcagcgccggaaaggaggccaagagcgcgggcggcgaggcaagatggcggcaaccaagaggaaacggcgtggaggctttgcagttcaggcgaagaagccaaaaagaaacgaaatagatgcggagccgccagctaagcggcacgccacagcagaggaggtggaggaagaagagagggaccggatcccaggccccgtttgcaagggaaagtggaaaaataaggaacggattctcatcttttcttccagaggaataaattttagaacaagacatttaatgcaggacttgagaatgttgatgcctcattctaaagcagatactaaaatggatcgtaaggataagctatttgtgattaacgaggtttgtgaaatgaagaactgtaataaatgcatctattttgaagctaagaaaaaacaggatctctatatgtggctttcaaattcacctcacggaccatctgctaaattccttgttcaaaatattcataccctcgctgaactgaagatgactggaaactgtttgaaaggttctcggccccttttgtcttttgaccctgcttttgatgaattaccacattatgctttgttaaaagaactcttaattcagatctttagtacaccacggtatcatcccaaaagccaaccatttgtggaccacgtgtttactttcaccattttggataataggatatggtttcggaactttcagatcatagaagaagatgctgctcttgtagaaataggacctcgttttgtcttaaatctcataaagattttccagggaagttttggaggaccaactttatatgaaaatcctcactaccagtcaccaaacatgcatcggcgtgtcataagatccatcacagctgcaaaatacagagagaaacagcaagtgaaagatgtgcaaaaactgagaaagaaagagccgaagactcttcttccacatgatcccactgcagatgtttgtacacngtgagggaaccatgaatacgtggtaaccagagcaagtggttgaagcgaagacggttcacagggagaaatgacgggtggggggacacacatcaggacgcttgtcggctttatatggcggggaacatcacaatcgcagggggccagaaaaaattaaggctttgtcgcgcaaaaagacaaaaatcgggctggagatatttgcaacaatcacggtganncgcaa

SEQ ID NO: 298182 - DNA, 1606 bp, Homo sapiens
gcttactagtctcggggtccccgagtgcggaaaccctacctttgcggtggggtctggacgcccgagagcccttctcagcaaagtccctgaagaggagcgaggcggctccgaggaaccgcggaggaagtgaagccagtcccgccactcttcagaccggccctccacctcggccaccgtcaccacagagctgaaggaggcctagagagccgcgcgtgccgcgccaccgagaccggaaggaggcggcacagacctggaggacgaccgcggagctgagcgcttagagccgccgaaccatagagatcggaaataggagcgagcggcagcgccggaaaggaggccaagagcgcgggcggcgaggcaagatggcggcaaccaagaggaaacggcgtggaggctttgcagttcaggcgaagaagccaaaaagaaacgaaatagatgcggagccgccagctaagcggcacgccacagcagaggaggtggaggaagaagagagggaccggatcccaggccccgtttgcaagggaaagtggaaaaataaggaacggattctcatcttttcttccagaggaataaattttagaacaagacatttaatgcaggacttgagaatgttgatgcctcattctaaagcagatactaaaatggatcgtaaggataagctatttgtgattaacgaggtttgtgaaatgaagaactgtaataaatgcatctattttgaagctaagaaaaaacaggatctctatatgtggctttcaaattcacctcacggaccatctgctaaattccttgttcaaaatattcataccctcgctgaactgaagatgactggaaactgtttgaaaggttctcggccccttttgtcttttgaccctgcttttgatgaattaccacattatgctttgttaaaagaactcttaattcagatctttagtacaccacggtatcatcccaaaagccaaccatttgtggaccacgtgtttactttcaccattttggataataggatatggtttcggaactttcagatcatagaagaagatgctgctcttgtagaaataggacctcgttttgtcttaaatctcataaagattttccagggaagttttggaggaccaactttatatgaaaatcctcactaccagtcaccaaacatgcatcggcgtgtcataagatccatcacagctgcaaaatacagagagaaacagcaagtgaaagatgtgcaaaaactgagaaagaaagagccgaagactcttcttccacatgatcccactgcagatgtttttgtaacaccagctgaggagaaaccaatagaaatacagtgggtaaaaccagagccaaaagttgatttgaaagcaagaaagaaacggatttacaaaaggcaaagaaaaatgaaacagaggatggacagtgggaaaacaaaataagtcaatggaaacctgatttgtttttcagttactttatatttattttgtattcaatgtgtaaatacttttattatctaatactatcttacgtctaattagtgtagcatttacaagaaagaaaaattaagatcttaaaatcagtgattatctttttctaaataaaatatcaccagaattcatca

SEQ ID NO: 298183 - DNA, 1823 bp, Homo sapiens
gcttactagtctcggggtccccgagtgcggaaaccctacctttgcggtggggtctggacgcccgagagcccttctcagcaaagtccctgaagaggagcgaggcggctccgaggaaccgcggaggaagtgaagccagtcccgccactcttcagaccggccctccacctcggccaccgtcaccacagagctgaaggaggcctagagagccgcgcgtgccgcgccaccgagaccggaaggaggcggcacagacctggaggacgaccgcggagctgagcgcttagagccgccgaaccatagagatcggaaataggagcgagcggcagcgccggaaaggaggccaagagcgcgggcggcgaggcaagatggcggcaaccaagaggaaacggcgtggaggctttgcagttcaggcgaagaagccaaaaagaaacgaaatagatgcggagccgccagctaagcggcacgccacagcagaggaggtggaggaagaagagagggaccggatcccaggccccgtttgcaagggaaagtggaaaaataaggaacggattctcatcttttcttccagaggaataaattttagaacaagacatttaatgcaggacttgagaatgttgatgcctcattctaaagcagatactaaaatggatcgtaaggataagctatttgtgattaacgaggtttgtgaaatgaagaactgtaataaatgcatctattttgaagctaagaaaaaacaggatctctatatgtggctttcaaattcacctcacggaccatctgctaaattccttgttcaaaatattcataccctcgctgaactgaagatgactggaaactgtttgaaaggttctcggccccttttgtcttttgaccctgcttttgatgaattaccacattatgctttgttaaaagaactcttaattcagatctttagtacaccacggtatcatcccaaaagccaaccatttgtggaccacgtgtttactttcaccattttggataataggatatggtttcggaactttcagatcatagaagaagatgctgctcttgtagaaataggacctcgttttgtcttaaatctcataaagattttccagggaagttttggaggaccaactttatatgaaaatcctcactaccagtcaccaaacatgcatcggcgtgtcataagatccatcacagctgcaaaatacagagagaaacagcaagtgaaagatgtgcaaaaactgagaaagaaagagccgaagactcttcttccacatgatcccactgcagatgtttttgtaacaccagctgaggagaaaccaatagaaatacagtgggtaaaaccagagccaaaagttgatttgaaagcaagaaagaaacggatttacaaaaggcaaagaaaaatgaaacagaggatggacagtgggaaaacaaaataagtcaatggaaacctgatttgtttttcagttactttatatttattttgtattcaatgtgtaaatacttttattatctaatactatcttacgtctaattagtgtagcatttacaagaaagaaaaattaagatcttaaaatcagtgattatctttttctaaataaaatatcaccagaattcatcagttaatttctgatttctttttgaagtttgtgttgctaaaaatgtagcacacttaatgtagcctgttctcttgggttggaatttttggtttagcaaagctgaaattcagacatttattaggtcatattatttgtaaaagcattcaacacttcaagagcatcggttgtggatggtaaagtaggagtagactggtagaaaggaaggcatctcactgaagt

SEQ ID NO: 298184 - DNA, 1277 bp, Homo sapiens
cggacgcgtgggtcgacccacgcgtccggcaagatggcggcaaccaagaggaaacggcgtggaggctttgcagttcaggcgaagaagccaaaaagaaacgaaatagatgcggagccgccagctaagcggcacgccacagcagaggaggtggaggaagaagagagggaccggatcccaggccccgtttgcaagggaaagtggaaaaataaggaacggattctcatcttttcttccagaggaataaattttagaacaagacatttaatgcaggacttgagaatgttgatgcctcattctaaagcagatactaaaatggatcgtaaggataagctatttgtgattaacgaggtttgtgaaatgaagaactgtaataaatgcatctattttgaagctaagaaaaaacaggatctctatatgtggctttcaaattcacctcacggaccatctgctaaattccttgttcaaaatattcataccctcgctgaactgaagatgactggaaactgtttgaaaggttctcggccccttttgtcttttgaccctgcttttgatgaattaccacattatgctttgttaaaagaactcttaattcagatctttagtacaccacggtatcatcccaaaagccaaccatttgtggaccacgtgtttactttcaccattttggataataggatatggtttcggaactttcagatcatagaagaagatgctgctcttgtagaaataggacctcgttttgtcttaaatctcataaagattttccagggaagttttggaggaccaactttatatgaaaatcctcactaccagtcaccaaacatgcatcggcgtgtcataagatccatcacagctgcaaaatacagagagaaacagcaagtgaaagatgtgcaaaaactgagaaagaaagagccgaagactcttcttccacatgatcccactgcagatgtttttgtaacaccagctgaggagaaaccaatagaaatacagtgggtaaaaccagagccaaaagttgatttgaaagcaagaaagaaacggatttacaaaaggcaaagaaaaatgaaacagaggatggacagtgggaaaacaaaataagtcaatggaaacctgatttgtttttcagttactttatatttattttgtattcaatgtgtaaatacttttattatctaatactatcttacgtctaattagtgtagcatttacaagaaagaaaaattaagatcttaaaatcagtgattatctttttctaaataaaatatcaccagaattcatca

SEQ ID NO: 298185 - DNA, 886 bp, Homo sapiens
cggacgcgtgggtcgacccacgcgtccggctttcaaattcacctcacggaccatctgctaaattccttgttcaaaatattcataccctcgctgaactgaagatgactggaaactgtttgaaaggttctcggccccttttgtcttttgaccctgcttttgatgaattaccacattatgctttgttaaaagaactcttaattcagatctttagtacaccacggtatcatcccaaaagccaaccatttgtggaccacgtgtttactttcaccattttggataataggatatggtttcggaactttcagatcatagaagaagatgctgctcttgtagaaataggacctcgttttgtcttaaatctcataaagattttccagggaagttttggaggaccaactttatatgaaaatcctcactaccagtcaccaaacatgcatcggcgtgtcataagatccatcacagctgcaaaatacagagagaaacagcaagtgaaagatgtgcaaaaactgagaaagaaagagccgaagactcttcttccacatgatcccactgcagatgtttttgtaacaccagctgaggagaaaccaatagaaatacagtgggtaaaaccagagccaaaagttgatttgaaagcaagaaagaaacggatttacaaaaggcaaagaaaaatgaaacagaggatggacagtgggaaaacaaaataagtcaatggaaacctgatttgtttttcagttactttatatttattttgtattcaatgtgtaaatacttttattatctaatactatcttacgtctaattagtgtagcatttacaagaaagaaaaattaagatcttaaaatcagtgattatctttttctaaataaaatatcaccagaattcatca

SEQ ID NO: 298186 - DNA, 2199 bp, Homo sapiens
  misc_feature (4)..(4): n is a, c, g, or t
  misc_feature (6)..(6): n is a, c, g, or t
  misc_feature (1332)..(1333): n is a, c, g, or t
  misc_feature (1337)..(1338): n is a, c, g, or t
  misc_feature (1343)..(1343): n is a, c, g, or t
  misc_feature (1349)..(1349): n is a, c, g, or t
  misc_feature (1376)..(1377): n is a, c, g, or t
  misc_feature (1384)..(1385): n is a, c, g, or t
  misc_feature (1388)..(1388): n is a, c, g, or t
  misc_feature (1395)..(1395): n is a, c, g, or t
  misc_feature (1407)..(1410): n is a, c, g, or t
  misc_feature (1415)..(1415): n is a, c, g, or t
  misc_feature (1430)..(1431): n is a, c, g, or t
  misc_feature (1436)..(1436): n is a, c, g, or t
  misc_feature (1438)..(1438): n is a, c, g, or t
  misc_feature (1449)..(1449): n is a, c, g, or t
  misc_feature (1494)..(1494): n is a, c, g, or t
  misc_feature (1506)..(1507): n is a, c, g, or t
  misc_feature (1511)..(1511): n is a, c, g, or t
  misc_feature (1532)..(1532): n is a, c, g, or t
  misc_feature (1542)..(1542): n is a, c, g, or t
  misc_feature (1547)..(1547): n is a, c, g, or t
  misc_feature (1552)..(1552): n is a, c, g, or t
  misc_feature (1555)..(1555): n is a, c, g, or t
  misc_feature (1564)..(1564): n is a, c, g, or t
  misc_feature (1570)..(1570): n is a, c, g, or t
  misc_feature (1572)..(1573): n is a, c, g, or t
  misc_feature (1580)..(1580): n is a, c, g, or t
  misc_feature (1594)..(1594): n is a, c, g, or t
  misc_feature (1596)..(1597): n is a, c, g, or t
  misc_feature (1610)..(1611): n is a, c, g, or t
  misc_feature (1613)..(1613): n is a, c, g, or t
  misc_feature (1624)..(1625): n is a, c, g, or t
  misc_feature (1636)..(1636): n is a, c, g, or t
  misc_feature (1640)..(1640): n is a, c, g, or t
cagnanaatttgttagtaggtttgcatagatataacaccttttcactggtataatacatcttttccaaaggattatggcaggcttgtttctattcttcatgtatattctctttttcactctttttttctgttttacatgaaattaaccatatttatcatctggctaccatagttccaaaataaggtccagtagtagtttgaagcacagcaagctcagcagtttcttccctttttaaagcccgacagtcagtggagttttctatagtcgagccacgtgagcactgtcaccccaagtagagactcttgtgaactcaaacggctccagattcacggtcaagaaccttggtgacttcacataactaccacttattgctggaagggagacaatattgtttgcttctgaagttttcaaacagtttctcacctggcagcttctccggatttctttgttgctttcataatcgcttctgacattgcgctttcaaaaatctaaaggtcgaatcatcatagttgtggaacgtaaggagtaactgggccctttgaagtagtgccactttatcccattcagttttccatggttttgtcccgcagtatagaacattccatttagattggaggggccacaagcatcaaaccaccatcctcctgttaacatgagggcacatttgcacatacagttgtcattatcagcatctttagtgctgaaatcagcaccgtgtaagatcaggctgctctgttttcctgctgtcccagtgtgaccttttaaatacaacctatagttttgcttttcatttcctatgtggaatctgtcatactgtgaataggctcggttcccttcccagtccattaactctcgtgccgaattcggcaccagctgatttgtttctatcttcctttcagcatgtcctgttttctaatacaataaaatgcttcgggtttatcttgtacttccctttccaattctggaataaccatttatccaaggaactccgattcctttggggagtgctatttggaaaccaaggtctggcactctaggtatgctcgtagcgatgggagcgtcattgcttccaggctctggctgtgtctcttcagggtccactatagtcatcctgtttctgtctgctgtagattatattaaagcttcattcttcatcccttccattttcctccctataagttagtgtctggaagcattcttagaggtcagacgaaatcattatattcaggtatggaatgcaatttttgtatagataacaaatctatattcatgaaatctgatgctgcccatcatccatctttttgcaaggtcttttcctgtgaaaggtatgnntttnnttttntttttnttttttttttttttgagacagagtctnnctctgtnnccnaggctgnagtgcagtggcnnnntctcngctcactgcaacctnngcctncngggttcaagcnattctcctgcctcagcctcctgagtagctgggattacaggcatgngccaccatgccnngctnattttgtatttttagtagagntggggtttcnccatnttggncangctggtctngaactncnnacctcangtgatccacccacntnngcctcccaaagtnntnggattacaggnntgagccaccgngccnggccagtcctttacttttataggtggagaaactgagacctaagaactgaagtgacttacgtccatggcaaattgattgcagagccaaaagtggagtccagatctcctaacttccatactagaacatttttgctgtggggagtggagagagattgggttgatggtacctgcctgaagtttccatggttgctgggtggaaacagcactcttccttctgtcttggcactcaagcatcccgatggacattgaatttttccaatgattggtcatttgatgaccaggcaggggagcagaaaaggagatagtacagaccagaagctgtttgaggatgtgttgttgcctgaccagacaccttgaggccagaattctaagtagtttcaaaactcctccctttcataccccatctactgactttctgctttcttcaaaatgctctgttggccaggtgcagtggttcacgcctgcaatcccaacacttaggctgaggcgggaggattacatgggcccaggagttcaagaccagttgaggcaacataaggggctgggcccttttctctacg

SEQ ID NO: 298187 - DNA, 1942 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaact

SEQ ID NO: 298188 - DNA, 782 bp, Homo sapiens
gctgtcaaaccggaagcctaagtagacccaatcttgttaatgaaatgttctgagctgtatcttgaagtttagaaaagtattcgttacatcttgtaggatctactttttgaacttttcattccccgtagttgaccattctgcaagtactagtcctctagaaataggttaaactgaagcaacttgatggaaggatctctccacagggcttgttttcccaagaaaagtattgtttggaggagccaaggtaaaagcctacctaagcatatcgtaaagctgttccaaaataactcagacccagtcttgtggatggaaatgtagtgctcgagtcacattctgcttaaagttgtaaccaatacagatgagtttaaaggaaaaaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgta

SEQ ID NO: 298189 - DNA, 471 bp, Homo sapiens
cctgatggtgttaatcccattgattttattggtcctcttacttttatccgtggtattccttgcaacatactataaaagaaaaagaactaaacaagatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298190 - DNA, 5227 bp, Homo sapiens
agattctttccattttttattaattgaagcacagagaaaagaggcaaaatgattaaagaaatttatgttttttagacagggtgttggctttacaccaacgaaaaagaaaaacagatgaataagcttttgatcttcattttctttctcttattctcatggtaggctgagatgcttttaaatgtgatgttataagcctaaggcagcttgacttgcagcaacaagttttttaccctcctcggcaaagcaggtctccttatcgtcagccttgcagcacttctctatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298191 - DNA, 5796 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcactggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298192 - DNA, 6001 bp, Homo sapiens
  misc_feature (5885)..(5885): n is a, c, g, or t
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctgaaaaaaaaaaaaaaaaaaaaaaaaaaaaaaaaaaanaaaaaaaaaaaaaaaaaaaaaaaaaaaaaaaaaaaaaaaaaaaaaaaaaaaaaaaaaaaaaaaacaaaaaaaagaaagaaaaaaaaaaaaaaaaaaaaaaaacaagaaaaaaaaaa

SEQ ID NO: 298193 - DNA, 4203 bp, Homo sapiens
agggagagaggattaactctagactggagtcgccttgtcgtcctgcttagcgagagaggcaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298194 - DNA, 4164 bp, Homo sapiens
gcaggattctcccgggggctatgttcttgtcatcaaggacgcatatccgaagaggtgggcagcactgttcaccagccaggtggcattaagcaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298195 - DNA, 5881 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctgaaaaaaaaaaaaaaaaaacaagaaaaaaaaaa

SEQ ID NO: 298196 - DNA, 5783 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagatggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298197 - DNA, 3339 bp, Homo sapiens
  misc_feature (1)..(1): n is a, c, g, or t
  misc_feature (6)..(6): n is a, c, g, or t
  misc_feature (8)..(8): n is a, c, g, or t
  misc_feature (11)..(11): n is a, c, g, or t
  misc_feature (26)..(26): n is a, c, g, or t
natgancnagnaggaggccgcgtgtnaatcggacgaggaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298198 - DNA, 5419 bp, Homo sapiens
  misc_feature (5408)..(5408): n is a, c, g, or t
  misc_feature (5412)..(5412): n is a, c, g, or t
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttcctcgccatcgaagggatcctcnagancgccgca

SEQ ID NO: 298199 - DNA, 2994 bp, Homo sapiens
  misc_feature (1)..(1): n is a, c, g, or t
  misc_feature (6)..(6): n is a, c, g, or t
  misc_feature (8)..(8): n is a, c, g, or t
  misc_feature (11)..(11): n is a, c, g, or t
  misc_feature (26)..(26): n is a, c, g, or t
natgancnagnaggaggccgcgtgtnaatcggacgaggattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298200 - DNA, 5794 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298201 - DNA, 5771 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298202 - DNA, 5451 bp, Homo sapiens
  misc_feature (5149)..(5149): n is a, c, g, or t
  misc_feature (5161)..(5161): n is a, c, g, or t
  misc_feature (5167)..(5167): n is a, c, g, or t
  misc_feature (5169)..(5169): n is a, c, g, or t
  misc_feature (5451)..(5451): n is a, c, g, or t
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagtttttttantggggttaaaanatggtngnacgcatcttcacaaagggacacacttcactcatggcgttggcacacaaatctgggggtgatatacatcatgcaaagtgctagctccaaaatgagggctcatcatgaaacagggctccacaacaagcgaggtgggccactgctcactgccgggaggtgaacgagcccaggccatccaccaaccaagtgtgaccacggacttcgtcggcgtgacctctggggcacactccacttaccactataagggggcactcaataaccatcccgtcaacagggggcaatan

SEQ ID NO: 298203 - DNA, 5596 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagtttttttttttctttgtggggtttaacaaaagtggttgtgttcccttttaaagtgtggaaacattttccccttgggtgtggcaaattctctgggggtgtattctcgtgaaaggtgttccctcaaattgggctttctcttgcaagggtttcacaaacccggaggtgtgcccagtgttgaagtgcgtgggtggtgtaagcgccaggggccctcctccaaacccgcttgtggtcgccagttgcatttttctctggtgctgccccctgggcaacgctctcttaacttaatagggggccccccaagctatccccgtcttgtttaccagggcgggcagtaaataatctgcgaccatacctcaaaggcggccgtttgagggcatgacctaagggcttttcgacacgcttttgtgcctgcttcgggccgggattcttcgccccgcttttttcatatgtgagtcc

SEQ ID NO: 298204 - DNA, 2902 bp, Homo sapiens
ccggtgcgacttttgaggaaccccccaaaaaaaaaaaaaaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298205 - DNA, 5285 bp, Homo sapiens
  misc_feature (5095)..(5095): n is a, c, g, or t
  misc_feature (5285)..(5285): n is a, c, g, or t
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgccccnttggtggggggggcatattcgcgtttggacttcagctctttccggtaacaaggtgtgcttctagggaatttcctggtggcgtatcgggctccgaggggccagcctgaggtaccggcgtttgtgggcggccacgcgggggcgggcaagcactcttgggaacacgcggtgatgccctttctgtgtcccaatn

SEQ ID NO: 298206 - DNA, 2664 bp, Homo sapiens
  misc_feature (43)..(43): n is a, c, g, or t
ctgctaactcaggggcgagctgctaactcaggggcgagctgcngaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298207 - DNA, 5319 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttcctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298208 - DNA, 2535 bp, Homo sapiens
  misc_feature (29)..(29): n is a, c, g, or t
  misc_feature (37)..(37): n is a, c, g, or t
aactatagctaggtacgaggccggggttnaatcggcngaggtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298209 - DNA, 4794 bp, Homo sapiens
  misc_feature (4678)..(4678): n is a, c, g, or t
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaaaaaaaaaaaaaaaaaaaaaaaaaaaaaaaaaaanaaaaaaaaaaaaaaaaaaaaaaaaaaaaaaaaaaaaaaaaaaaaaaaaaaaaaaaaaaaaaaaacaaaaaaaagaaagaaaaaaaaaaaaaaaaaaaaaaaacaagaaaaaaaaaa

SEQ ID NO: 298210 - DNA, 1936 bp, Homo sapiens
taaccttatggctaggtacgaggcctgggtgttagctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298211 - DNA, 1855 bp, Homo sapiens
tcgtagacgtcggccatccatcagatgaggcctgactgcagtgagcagggacccggcgcgcggtggcggcctcgtcaaggggcaacgcgctgctgccttgctgctaccttttggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298212 - DNA, 1989 bp, Homo sapiens
gctgtcaaaccggaagcctaagtagacccaatcttgttaatgaaatgttctgagctgtatcttgaagtttagaaaagtattcgttacatcttgtaggatctactttttgaacttttcattccccgtagttgaccattctgcaagtactagtcctctagaaataggttaaactgaagcaacttgatggaaggatctctccacagggcttgttttcccaagaaaagtattgtttggaggagccaaggtaaaagcctacctaagcatatcgtaaagctgttccaaaataactcagacccagtcttgtggatggaaatgtagtgctcgagtcacattctgcttaaagttgtaaccaatacagatgagtttaaaggaaaaaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298213 - DNA, 1130 bp, Homo sapiens
  misc_feature (29)..(29): n is a, c, g, or t
  misc_feature (37)..(37): n is a, c, g, or t
aactatagctaggtacgaggccggggttnaatcggcngagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298214 - DNA, 2738 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatggatcagatcccctcatgatttcccgcataagcgtaggcattgtgtgaatgagatttggagactattagggttgcagcctactgagttaagtcttgcccgtatgtaataagtgtagat

SEQ ID NO: 298215 - DNA, 2242 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgtcgcccagcggggtaccggctcgattcgatcatgtca

SEQ ID NO: 298216 - DNA, 1979 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccagaaggaccttctggccacgctagaaagaagctcgccccacctccacctgtgagatccgtgaattctcggaatggcaggggaagccttgcactaggttgcagagaagcatcctccacat

SEQ ID NO: 298217 - DNA, 1788 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtgagtgaagccctgatggaggtggggatatggccctggcacctggtcattagggaccccattttttctcctgagactttcaaaatataagctgagaaatttgctgggtttgcatgttcacaatcttaatttaaaatcccaatttttaacatcccacgggcccgtagccatagactattgctccatttctttctctctggctgttctactttgcactgcccagccagactgaacatctcacagttcccccacggtatcaggtggg

SEQ ID NO: 298218 - DNA, 1707 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagccacttggaaacaagccagtcttttctgcaaggtcagttgaccaagagcatatttcccctctgttgtacatcgttgttttgtgtttgtgttgtaacagtgggtggagggagggtggggtctacatttgttgcatgagtcgatgggtcagaactttagtatacgcatgcgtcctctgagtgacagggcattttgtcgaaaataagcaccttggtaactaaacccctctaatagctataaaggctttagttctgtattgattaagttactgtaaaagcttgggtttatttttgtaggacttaatggctaagaattagaacatagcaagggggctcctctgttggagtaatgtaaattgtaattataaataaacatgcaaacctttaaaattt

SEQ ID NO: 298219 - DNA, 684 bp, Homo sapiens
gtcctgggactttaagttgcttttttctacttaagcttcagtggcaagttgggagaagaagggaggcaactccatgactcctttggagcccagattcctgggtattttgtgaggttgggctgagcgccttgggctcttgatacctgtccattgggattctcctaatagggtgtctatcctcaagccttacattcctcttctctctctccccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtgagtgaagccctgatggaggtggggatatggccctggcacctggtcattagggaccccattttttctcctgagactttcaaaatataagctgagaaatttgctgggtttgcatgttcacaatcttaatttaaaatcccaatttttaacatcccacgggcccgtagccatagactattgctccatttctttctctctggctgttctactttgcactgcccagccagactgaacatctcacagttcccccacggtatcaggtggg

SEQ ID NO: 298220 - DNA, 5850 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298221 - DNA, 1496 bp, Homo sapiens
  misc_feature (1347)..(1347): n is a, c, g, or t
  misc_feature (1363)..(1363): n is a, c, g, or t
  misc_feature (1409)..(1409): n is a, c, g, or t
  misc_feature (1427)..(1427): n is a, c, g, or t
  misc_feature (1494)..(1494): n is a, c, g, or t
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaaggcttggcccccttacgggctctttttcttgaatcatttgcccaaaccaccaaaatggggcatttccccaaaaaaatggaattngttcttaattgaaaanttgggggcttccggttggaacccaacccggttggcccccaccccancaaaagtttttttcccanaaaaaaaccacccattggcttggaatttcccttccatttaaattttccccccgaaaccgtttgggcntt

SEQ ID NO: 298222 - DNA, 4819 bp, Homo sapiens
ggcacgagggagagtctgtttttcttcctaaaatttggactcttgtctgcacaaacactgggcataacagcaggagcgctggaacattctgcctcttgagtgaaggggccttctttctagcctctatggcactgaggggtgcgccggctggtggaggagtagtccgatggagccctgcgttccccggggacacagggccaagctttgaggtggaaagtttctggttctgaaacctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298223 - DNA, 4746 bp, Homo sapiens
gtcctgggactttaagttgcttttttctacttaagcttcagtggcaagttgggagaagaagggaggcaactccatgactcctttggagcccagattcctgggtattttgtgaggttgggctgagcgccttgggctcttgatacctgtccattgggattctcctaatagggtgtctatcctcaagccttacattcctcttctctctctccccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298224 - DNA, 4163 bp, Homo sapiens
taactggtgtgcacaaatcaagaaaacctcaatgcaccgtcactccataacttctcgcttttgtttcaggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298225 - DNA, 5864 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattctctccacctctcctccttccattttcccccaatactgcagcacctccaggcctgtgtgctatgagagccaacctgtatgtcaataaacaacagctgaagcaa

SEQ ID NO: 298226 - DNA, 5791 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298227 - DNA, 5670 bp, Homo sapiens
  misc_feature (5670)..(5670): n is a, c, g, or t
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttagctctcttagatcgcatcttttggatctttcatctcaccgcttcctcttgacctcgtgttatactttattcttactgcttgtcctcctatactctttcatcctttccctcttcatcctcgattctctctttctctccttcagcgttctttcatgcaacctttcttcactcctatctttcatatcttgtttttttctttctatcttccttaatctctctctctcctttttatatagaactctgcactcgtactctcttcgtctttttctctttcttcttcn

SEQ ID NO: 298228 - DNA, 5982 bp, Homo sapiens
  misc_feature (5246)..(5246): n is a, c, g, or t
  misc_feature (5717)..(5717): n is a, c, g, or t
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttggggttataaaagatgggggtgggtagcatttttaaaatgtggaaaaatttctcctcctgtgggtttggctagtatactcttgggggtgttattctcntcgtgtataagtgtgatagcctcaaatataggctcactcatgtaaagggtttaaaaaagcgaagggtggccagtgttaaatgtgcggtgggtggatatagggccagggccttcttccaaccactgtggtgccaatgtgactgtgtgcgtggtgatgaccccgtgggcaagctccattataacttattaggggtgccttcaagtttcccttctcgtggtaaaaaggggggattaattaattactggacctaccttaaaggggcgagtttttgtgaggctttgactaagtgcttgactgacaaacaagagccatttggggggaacccctttcagccaccgggggaattctctcaaaaacccgggagctattcttctgactcaaataggaaatggtcccaccaggaaacgtggaaaaacgtccgtgttgctccccacaaggctggccataaggtcgtagtggggttcctcccangacaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298229 - DNA, 5269 bp, Homo sapiens
  misc_feature (5153)..(5153): n is a, c, g, or t
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagtttttttaaaaantaacggggtgaaagatggtggggtttaaaggaaaatgtcctgggtgcaaaaattgggggatactggagaggggtcaaagggctcggaaggttaaaagcggggcattgcggggtaag

SEQ ID NO: 298230 - DNA, 5709 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298231 - DNA, 5254 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagacttgaagaacccccttaacttggaacagtggggcttggggtaagaaacacaaacgggcggccttgaagttgggaggattatcagtaatcaacgatttgcaagggatttccccttttctgggggccttttcaatttttcctttgggggcgaacaaaactaaaaaccccctttttttttaaaccaattaggggggttaccttcaaacaccgggaggggaggggccctttgggcctttttttcctttaaagttgccccaacatttggaatcggaagggggtggaacaa

SEQ ID NO: 298232 - DNA, 4643 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgta

SEQ ID NO: 298233 - DNA, 4921 bp, Homo sapiens
  misc_feature (4921)..(4921): n is a, c, g, or t
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaaaaaaaaaaaaaaaaaaaaaaaaaaaaaaaaaaaaaaaaaacggggggtttttttgggggggggggaaaaaggggatatgataagagaaagtgggacaagtgggtctaataagaggtgtgtttcagcgtaacccacaagtttttctgtgaataaaaggtggggataatatcttggcggggtctatcccatatatgtaggtggagggaaatatataatattgtcagaaaagacgccagaggggtgtaaacccgggatattaaagaatctgggacacatn

SEQ ID NO: 298234 - DNA, 2395 bp, Homo sapiens
  misc_feature (43)..(43): n is a, c, g, or t
ctgctaactcaggggcgagctgctaactcaggggcgagctgcncttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298235 - DNA, 4511 bp, Homo sapiens
  misc_feature (4408)..(4408): n is a, c, g, or t
  misc_feature (4411)..(4412): n is a, c, g, or t
  misc_feature (4422)..(4422): n is a, c, g, or t
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctccttnggnnatgcggaacncaggggtagcgggctaaggccccgcgtttgggctccccgggaagggtccgggagcacgggttcgttcgggcgggccaacccgggagtgg

SEQ ID NO: 298236 - DNA, 3739 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttggggttaaaagatggttgtagcatttaaaatggaaaattttctcctgggttggctagtatctggggtgtattctctgtaagtgtagctcaaataggtcatcatgaaaggttaaaaaagcgaggtggccatgttatgcctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttggggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctga

SEQ ID NO: 298237 - DNA, 2532 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgta

SEQ ID NO: 298238 - DNA, 2264 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctcttagggcgtcttgtcacaggcttcgggtcagacggattcaaccctgcatcagccatttgtagccaggtcactctgttctttgtctgtaaatgaga

SEQ ID NO: 298239 - DNA, 2030 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggggtattctactattttgtcagtgccctgggcataacagcaggagctcatcgtctgtggagccaccgctcttacaaagctcggctgcccctacggctctttctgatcattgccaacacaatggcattccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtactacaaacctggcttgctgatgatgtgcttcatcctgcccacgcttgtgccctggtatttctggggtgaaacttttcaaaacagtgtgttcgttgccactttcttgcgatatgctgtggtgcttaatgccacctggctggtgaacagtgctgcccacctcttcggatatcgtccttatgacaagaacattagcccccgggagaatatcctggtttcacttggagctgtgggtaagtcagctgtccaagtaagactacatccagtggtctgctgattaggggattaggctaggagccagaaaaactagataaatctgttttttatggctactttgtatctcagtttttccactataaaattagggggcagtatactggaaaacgcttttgagagtcaggcaacatgttttatgtaaaaatgaaaggataagaaacaaaacacaaaaaaacactgattttgattccaggttctaaaacaatttccaaatgccatgtatgctccggg

SEQ ID NO: 298240 - DNA, 1200 bp, Homo sapiens
agggaggcggggcttcccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtattcgtctctgatataaaagatgatatatatgaccccacctacgaggataaggaaggcccgc

SEQ ID NO: 298241 - DNA, 736 bp, Homo sapiens
acagcttgtactctgcctctgactctcttccaagaacaatttggcaagttctaatctacatcttgcaaaaaaaaaacaaaaaacaaaaaacagagaggtaggagggccacagcacctggggtcccagaaggcagactgacctattcctacagcagggagacaaggtctcattctgttgcccaggctggagtgcagtggtgcaatcacggttcactgcaacctggaactccagggttcaagcaatcctcctgcctcagcctgccgagtagctgtgacaacaggtgcgagccaccatgcccagctaagatttcaccatgttgcccagctggtcttgaactcctggcctcaagcaattctcctgctttaggctcccaagttgctggaattacagggctgcacggagcctgctgagtctccaacccacctcgctcaccgctctgaccactgacaggcagagcaaaggatgcgggagttgcctctgctgcccatctaaggggacgtaggcagagaagcaaaggcctctgctctccctccatccatcccggtgtgctggccccaacggaacaggagtccttcaactattgcctgccagagacccaattgcagggactgtagtctgcatctggatgagctgggctgtagattgaagtctcagaagcagggaaggttggaaggggtagggtcccagagcccatggagttattgctgagaagatatgcaggggacacattcccca

SEQ ID NO: 298242 - DNA, 491 bp, Homo sapiens
caaacgccatctttgaaggaccgtgcttccttcgaagaatcaggatgcccatgagagaccaaagcagtctcttggcccctagacatgccctccaggaacaacctggctgtgagcggagagtctaacaggcaagaaggaagggagaagacagaaggaagatgctcgcccatacagagacagagggagggggggctccaaagccgaaagaggaggtccccaagtactgtggacactagccaggtatatatgcagaggctgcaggaggcaatgtctgatttgcgtagggctcaggggagagatgaaaacacaaatcatatggaagatgggaaccctcaggcctacctcaacttaaaaatgggtgtaataacagtaccggccttctagcattgttagggagattaaatgtgatcatgcattcaagggcttagcacggggccaggctgctgggaaaggcttgatgatagtatcggcaataaaacctgtacaattac

SEQ ID NO: 298243 - DNA, 635 bp, Homo sapiens
gacagtgctctgattttcctctcctctccctgtttccagcccccttttatcccccgtagtgacaaaggccaagacatcaatgtggccaggtcccaccttccggctgtcggggagagtcttctgccggaggcgcatctccaagtccccagctcttcctggccccttgttttgctctcagccatgagctgtcttcgtggcttttcagtacattcattaacctttgtgcagggggtccttgggagagactaaaaggactgggtgatactttatgtcaccatgttgtgctcagaagcatatatctttaatgctattctttaatgttgcaaaccatagttttgcaacatatcaaatgtatccctaatgaaaattcagacccaaaggcttaggaaccctaaaatttctaagagttttgatttaaaacttcattcatagttttaaataatacagcagatcttcaaatagcattgtttcattcaacatcattttgttacaataatgatgagaatcggtactttgacttcctcccacgtcccaaagatatacaggtgaagtttactggcatgtcagtgagtgtgggtttgtaagtgcaccctgcgatgatatgcatcttgtccagggctggttcccatcttgtg

SEQ ID NO: 298244 - DNA, 1927 bp, Homo sapiens
gacttgcaaaaccacagataatgttcagcccagcacagtaggggtcaatttggtccacttgctcagtgacaaaaagaaaaaaaaagtgggctgtcactaaagattttgactcacaagagaggggctggtctggaggtgggaggagggagtgacgagtcaaggaggagacagggacgcaggagggtgcaaggaagtgtcttaactgagacgggggtaaggcaagagagggtggaggaaattctgcaggagacaggcttcctccagggtctggagaacccagaggcagctcctcctgagtgctgggaaggactctgggcatcttcagcccttcttactctctgaggctcaagccagaaattcaggctgcttgcagagtgggtgacagagccacggagctggtgtccctgggaccctctgcccgtcttctctccactccccagcatggaggaaggtggtgattttgacaactactatggggcagacaaccagtctgagtgtgagtacacagactggaaatcctcgggggccctcatccctgccatctacatgttggtcttcctcctgggcaccacgggaaacggtctggtgctctggaccgtgtttcggagcagccgggagaagaggcgctcagctgatatcttcattgctagcctggcggtggctgacctgaccttcgtggtgacgctgcccctgtgggctacctacacgtaccgggactatgactggccctttgggaccttcttctgcaagctcagcagctacctcatcttcgtcaacatgtacgccagcgtcttctgcctcaccggcctcagcttcgaccgctacctggccatcgtgaggccagtggccaatgctcggctgaggctgcgggtcagcggggccgtggccacggcagttctttgggtgctggccgccctcctggccatgcctgtcatggtgttacgcaccaccggggacttggagaacaccactaaggtgcagtgctacatggactactccatggtggccactgtgagctcagagtgggcctgggaggtgggccttggggtctcgtccaccaccgtgggctttgtggtgcccttcaccatcatgctgacctgttacttcttcatcgcccaaaccatcgctggccacttccgcaaggaacgcatcgagggcctgcggaagcggcgccggctgctcagcatcatcgtggtgctggtggtgacctttgccctgtgctggatgccctaccacctggtgaagacgctgtacatgctgggcagcctgctgcactggccctgtgactttgacctcttcctcatgaacatcttcccctactgcacctgcatcagctacgtcaacagctgcctcaaccccttcctctatgcctttttcgacccccgcttccgccaggcctgcacctccatgctctgctgtggccagagcaggtgcgcaggcacctcccacagcagcagtggggagaagtcagccagctactcttcggggcacagccaggggcccggccccaacatgggcaagggtggagaacagatgcacgagaaatccatcccctacagccaggagacccttgtggttgactagggctgggagcagagagaagcctggcgccctcggccctccccggcctttgcccttgctttctgaaaatcagacctcctctgcccagagctgtcctcaaagcatccagtgaacactggaagaggcttctagaagggaagaaattgtccctctgaggccgccgtgggtgacctgcagagacttcctgcctggaactcatctgtgaactgggacagaagcagaggaggctgcctgctgtgatacccccttacctcccccagtgccttcttcagaatatctgcactgtcttctgatcctgttagtcactgtggttcatcaaataaaactgtttgtgcaaaaaaaatgt

SEQ ID NO: 298245 - DNA, 3864 bp, Homo sapiens
gacttgcaaaaccacagataatgttcagcccagcacagtaggggtcaatttggtccacttgctcagtgacaaaaagaaaaaaaaagtgggctgtcactaaagattttgactcacaagagaggggctggtctggaggtgggaggagggagtgacgagtcaaggaggagacagggacgcaggagggtgcaaggaagtgtcttaactgagacgggggtaaggcaagagagggtggaggaaattctgcaggagacaggcttcctccagggtctggagaacccagaggcagctcctcctgagtgctgggaaggactctgggcatcttcagcccttcttactctctgaggctcaagccagaaattcaggctgcttgcagagtgggtgacagagccacggagctggtgtccctgggaccctctgcccgtcttctctccactccccagcatggaggaaggtggtgattttgacaactactatggggcagacaaccagtctgagtgtgagtacacagactggaaatcctcgggggccctcatccctgccatctacatgttggtcttcctcctgggcaccacgggaaacggtctggtgctctggaccgtgtttcggagcagccgggagaagaggcgctcagctgatatcttcattgctagcctggcggtggctgacctgaccttcgtggtgacgctgcccctgtgggctacctacacgtaccgggactatgactggccctttgggaccttcttctgcaagctcagcagctacctcatcttcgtcaacatgtacgccagcgtcttctgcctcaccggcctcagcttcgaccgctacctggccatcgtgaggccagtggccaatgctcggctgaggctgcgggtcagcggggccgtggccacggcagttctttgggtgctggccgccctcctggccatgcctgtcatggtgttacgcaccaccggggacttggagaacaccactaaggtgcagtgctacatggactactccatggtggccactgtgagctcagagtgggcctgggaggtgggccttggggtctcgtccaccaccgtgggctttgtggtgcccttcaccatcatgctgacctgttacttcttcatcgcccaaaccatcgctggccacttccgcaaggaacgcatcgagggcctgcggaagcggcgccggctgctcagcatcatcgtggtgctggtggtgacctttgccctgtgctggatgccctaccacctggtgaagacgctgtacatgctgggcagcctgctgcactggccctgtgactttgacctcttcctcatgaacatcttcccctactgcacctgcatcagctacgtcaacagctgcctcaaccccttcctctatgcctttttcgacccccgcttccgccaggcctgcacctccatgctctgctgtggccagagcaggtgcgcaggcacctcccacagcagcagtggggagaagtcagccagctactcttcggggcacagccaggggcccggccccaacatgggcaagggtggagaacagatgcacgagaaatccatcccctacagccaggagacccttgtggttgactagggctgggagcagagagaagcctggcgccctcggccctccccggcctttgcccttgctttctgaaaatcaggtagtgtggctactccttgtcctatgcacatcctttaactgtcccctgattctgccccgccctgtcctcctctactgctttattctttctcagaggtttgtggtttaggggaaagagactgggctctacagacctgaccctgcacaagccatttaatctcactcagcctcagtttctccattggtatgaaatgggggaaagtcatattgatcctaaaatgttgaagcctgagtctggacgcagtaaaagcttgtttccctctgctgctttcttagatctgcaatcgtctttcctcccttctttccttgtagtttttcccccaccactctctgcagctgccgctccttatccctgccttctggcaccaatcccctcctacagctcgtccccctccctccatccatccttctcccctgtctactttcttgttctgaagggctactaagggttaaggatcccaaagcttgcagagactgaccctgtttaagctttctatcctgttttctgagtgtgaggcagggaatgggctggggccgggggtgggctgtgtgtcagcagataattagtgctccagcccttagatctgggagctccagagcttgccctaaaattggatcacttccctgtcattttgggcattggggctagtgtgattcctgcagttcccccatggcaccatgacactgactagatatgctttctccaaattgtccgcagaccctttcatccttcctctattttctatgagaattggaaggcagcagggctgatgaatggatgtactccttggtttcattatgtgagtggggagttgggaagggcaactagagagagaggatggaggggtgtctgcatttagtccagacactgcttggctcgctccccgagtcctcctgtttctgacttcctgcataactgtgagctgaagggtttcctcatctccccatcttaccccatcatactgatttctttcttgggcactggtgctacttggtgccaagaatcatgttgtttgggatggagatgcctgcctcttgtctgtgtgtgttgtacttatatgtctatatggatgagcctggcatgaacagcagtgtgcctgggtcatttggacaaatctcctcccaccccccaatccactgcaactctgctgttcatacattacccttggcagggggtggtggggggcagggacacactgaggcaatgaaaaatgtagaataaaaatgagtccaccccctactggatttgggggctccaacggctggtccgtgctttaggagcgaagttaatgtttgcaccaggcttcctgtagggagatccctccccaaagcagctggcgccaaggcttgggggcgtcctactgagctgggttcctgctccttcttgggctccatgaaggaagtaagaggctagttgagagcctcccttggcccctttccagtgcctccccgcctggcttcaaatttatgagcattgccctcatcgtcctttcttgttccagggtcagtggccctcttcctaaggaggcctcctgcttgccatgggccaaaaggcacggggtgggttttttctctccctaccctcaggattggacctcttggcttctgctggattggggatctgggaatagggactggagcaagtgtgcagatagcatgatgtctacactgccagagagaccgtgaggatgaaattaatagtggggcctttgtgagctagaggctgggagtgtctattccgggttttgttcttggaggactatgaaagtgaaggacaagacatgagcgatggagataagaaaagcccagcttgatgtgaatggacatcttgaccctccctggaatgacgccagctctgggggcagagggaggaggagaggggaaggggctcctcacagcctagtctccccatcttaagatagcatctttcacagagtcacctcctctgcccagagctgtcctcaaagcatccagtgaacactggaagaggcttctagaagggaagaaattgtccctctgaggccgccgtgggtgacctgcagagacttcctgcctggaactcatctgtgaactgggacagaagcagaggaggctgcctgctgtgatacccccttacctcccccagtgccttcttcagaatatctgcactgtcttctgatcctgttagtcactgtggttcatcaaataaaactgtttgtgcaaaaaaaatgt

SEQ ID NO: 298246 - DNA, 2758 bp, Homo sapiens
gacttgcaaaaccacagataatgttcagcccagcacagtaggggtcaatttggtccacttgctcagtgacaaaaagaaaaaaaaagtgggctgtcactaaagattttgactcacaagagaggggctggtctggaggtgggaggagggagtgacgagtcaaggaggagacagggacgcaggagggtgcaaggaagtgtcttaactgagacgggggtaaggcaagagagggtggaggaaattctgcaggagacaggcttcctccagggtctggagaacccagaggcagctcctcctgagtgctgggaaggactctgggcatcttcagcccttcttactctctgaggctcaagccagaaattcaggctgcttgcagagtgggtgacacagccaggggcccggccccaacatgggcaagggtggagaacagatgcacgagaaatccatcccctacagccaggagacccttgtggttgactagggctgggagcagagagaagcctggcgccctcggccctccccggcctttgcccttgctttctgaaaatcaggtagtgtggctactccttgtcctatgcacatcctttaactgtcccctgattctgccccgccctgtcctcctctactgctttattctttctcagaggtttgtggtttaggggaaagagactgggctctacagacctgaccctgcacaagccatttaatctcactcagcctcagtttctccattggtatgaaatgggggaaagtcatattgatcctaaaatgttgaagcctgagtctggacgcagtaaaagcttgtttccctctgctgctttcttagatctgcaatcgtctttcctcccttctttccttgtagtttttcccccaccactctctgcagctgccgctccttatccctgccttctggcaccaatcccctcctacagctcgtccccctccctccatccatccttctcccctgtctactttcttgttctgaagggctactaagggttaaggatcccaaagcttgcagagactgaccctgtttaagctttctatcctgttttctgagtgtgaggcagggaatgggctggggccgggggtgggctgtgtgtcagcagataattagtgctccagcccttagatctgggagctccagagcttgccctaaaattggatcacttccctgtcattttgggcattggggctagtgtgattcctgcagttcccccatggcaccatgacactgactagatatgctttctccaaattgtccgcagaccctttcatccttcctctattttctatgagaattggaaggcagcagggctgatgaatggatgtactccttggtttcattatgtgagtggggagttgggaagggcaactagagagagaggatggaggggtgtctgcatttagtccagacactgcttggctcgctccccgagtcctcctgtttctgacttcctgcataactgtgagctgaagggtttcctcatctccccatcttaccccatcatactgatttctttcttgggcactggtgctacttggtgccaagaatcatgttgtttgggatggagatgcctgcctcttgtctgtgtgtgttgtacttatatgtctatatggatgagcctggcatgaacagcagtgtgcctgggtcatttggacaaatctcctcccaccccccaatccactgcaactctgctgttcatacattacccttggcagggggtggtggggggcagggacacactgaggcaatgaaaaatgtagaataaaaatgagtccaccccctactggatttgggggctccaacggctggtccgtgctttaggagcgaagttaatgtttgcaccaggcttcctgtagggagatccctccccaaagcagctggcgccaaggcttgggggcgtcctactgagctgggttcctgctccttcttgggctccatgaaggaagtaagaggctagttgagagcctcccttggcccctttccagtgcctccccgcctggcttcaaatttatgagcattgccctcatcgtcctttcttgttccagggtcagtggccctcttcctaaggaggcctcctgcttgccatgggccaaaaggcacggggtgggttttttctctccctaccctcaggattggacctcttggcttctgctggattggggatctgggaatagggactggagcaagtgtgcagatagcatgatgtctacactgccagagagaccgtgaggatgaaattaatagtggggcctttgtgagctagaggctgggagtgtctattccgggttttgttcttggaggactatgaaagtgaaggacaagacatgagcgatggagataagaaaagcccagcttgatgtgaatggacatcttgaccctccctggaatgacgccagctctgggggcagagggaggaggagaggggaaggggctcctcacagcctagtctccccatcttaagatagcatctttcacagagtcacctcctctgcccagagctgtcctcaaagcatccagtgaacactggaagaggcttctagaagggaagaaattgtccctctgaggccgccgtgggtgacctgcagagacttcctgcctggaactcatctgtgaactgggacagaagcagaggaggctgcctgctgtgatacccccttacctcccccagtgccttcttcagaatatctgcactgtcttctgatcctgttagtcactgtggttcatcaaataaaactgtttgtgcaaaaaaaatgt

SEQ ID NO: 298247 - DNA, 3810 bp, Homo sapiens
gacttgcaaaaccacagataatgttcagcccagcacagtaggggtcaatttggtccacttgctcagtgacaaaaagaaaaaaaaagtgggctgtcactaaagattttgactcacaagagaggggctggtctggaggtgggaggagggagtgacgagtcaaggaggagacagggacgcaggagggtgcaaggaagtgtcttaactgagacgggggtaaggcaagagagggtggaggaaattctgcaggagacaggcttcctccagggtctggagaacccagaggcagctcctcctgagtgctgggaaggactctgggcatcttcagcccttcttactctctgaggctcaagccagaaattcaggctgcttgcagagtgggtgacagagccacggagctggtgtccctgggaccctctgcccgtcttctctccactccccagcatggaggaaggtggtgattttgacaactactatggggcagacaaccagtctgagtgtgagtacacagactggaaatcctcgggggccctcatccctgccatctacatgttggtcttcctcctgggcaccacgggaaacggtctggtgctctggaccgtgtttcggagcagccgggagaagaggcgctcagctgatatcttcattgctagcctggcggtggctgacctgaccttcgtggtgacgctgcccctgtgggctacctacacgtaccgggactatgactggccctttgggaccttcttctgcaagctcagcagctacctcatcttcgtcaacatgtacgccagcgtcttctgcctcaccggcctcagcttcgaccgctacctggccatcgtgaggccagtggccaatgctcggctgaggctgcgggtcagcggggccgtggccacggcagttctttgggtgctggccgccctcctggccatgcctgtcatggtgttacgcaccaccggggacttggagaacaccactaaggtgcagtgctacatggactactccatggtggccactgtgagctcagagtgggcctgggaggtgggccttggggtctcgtccaccaccgtgggctttgtggtgcccttcaccatcatgctgacctgttacttcttcatcgcccaaaccatcgctggccacttccgcaaggaacgcatcgagggcctgcggaagcggcgccggctgctcagcatcatcgtggtgctggtggtgacctttgccctgtgctggatgccctaccacctggtgaagacgctgtacatgctgggcagcctgctgcactggccctgtgactttgacctcttcctcatgaacatcttcccctactgcacctgcatcagctacgtcaacagctgcctcaaccccttcctctatgcctttttcgacccccgcttccgccaggcctgcacctccatgctctgctgtggccagagcaggtgcgcaggcacctcccacagcagcagtggggagaagtcagccagctactcttcggggcacagccaggggcccggccccaacatgggcaagggtggagaacagatgcacgagaaatccatcccctacagccaggagacccttgtggttgactagggctgggagcagagagaagcctggcgccctcggccctccccggcctttgcccttgctttctgaaaatcaggtagtgtggctactccttgtcctatgcacatcctttaactgtcccctgattctgccccgccctgtcctcctctactgctttattctttctcagaggtttgtggtttaggggaaagagactgggctctacagacctgaccctgcacaagccatttaatctcactcagcctcagtttctccattggtatgaaatgggggaaagtcatattgatcctaaaatgttgaagcctgagtctggacgcagtaaaagcttgtttccctctgctgctttcttagatctgcaatcgtctttcctcccttctttccttgtagtttttcccccaccactctctgcagctgccgctccttatccctgccttctggcaccaatcccctcctacagctcgtccccctccctccatccatccttctcccctgtctactttcttgttctgaagggctactaagggttaaggatcccaaagcttgcagagactgaccctgtttaagctttctatcctgttttctgagtgtgaggcagggaatgggctggggccgggggtgggctgtgtgtcagcagataattagtgctccagcccttagatctgggagctccagagcttgccctaaaattggatcacttccctgtcattttgggcattggggctagtgtgattcctgcagttcccccatggcaccatgacactgactagatatgctttctccaaattgtccgcagaccctttcatccttcctctattttctatgagaattggaaggcagcagggctgatgaatggatgtactccttggtttcattatgtgagtggggagttgggaagggcaactagagagagaggatggaggggtgtctgcatttagtccagacactgcttggctcgctccccgagtcctcctgtttctgacttcctgcataactgtgagctgaagggtttcctcatctccccatcttaccccatcatactgatttctttcttgggcactggtgctacttggtgccaagaatcatgttgtttgggatggagatgcctgcctcttgtctgtgtgtgttgtacttatatgtctatatggatgagcctggcatgaacagcagtgtgcctgggtcatttggacaaatctcctcccaccccccaatccactgcaactctgctgttcatacattacccttggcagggggtggtggggggcagggacacactgaggcaatgaaaaatgtagaataaaaatgagtccaccccctactggatttgggggctccaacggctggtccgtgctttaggagcgaagttaatgtttgcaccaggcttcctgtagggagatccctccccaaagcagctggcgccaaggcttgggggcgtcctactgagctgggttcctgctccttcttgggctccatgaaggaagtaagaggctagttgagagcctcccttggcccctttccagtgcctccccgcctggcttcaaatttatgagcattgccctcatcgtcctttcttgttccagggtcagtggccctcttcctaaggaggcctcctgcttgccatgggccaaaaggcacggggtgggttttttctctccctaccctcaggattggacctcttggcttctgctggattggggatctgggaatagggactggagcaagtgtgcagatagcatgatgtctacactgccagagagaccgtgaggatgaaattaatagtggggcctttgtgagctagaggctgggagtgtctattccgggttttgttcttggaggactatgaaagtgaaggacaagacatgagcgatggagataagctctgggggcagagggaggaggagaggggaaggggctcctcacagcctagtctccccatcttaagatagcatctttcacagagtcacctcctctgcccagagctgtcctcaaagcatccagtgaacactggaagaggcttctagaagggaagaaattgtccctctgaggccgccgtgggtgacctgcagagacttcctgcctggaactcatctgtgaactgggacagaagcagaggaggctgcctgctgtgatacccccttacctcccccagtgccttcttcagaatatctgcactgtcttctgatcctgttagtcactgtggttcatcaaataaaactgtttgtgcaaaaaaaatgt

SEQ ID NO: 298248 - DNA, 3779 bp, Homo sapiens
gacttgcaaaaccacagataatgttcagcccagcacagtaggggtcaatttggtccacttgctcagtgacaaaaagaaaaaaaaagtgggctgtcactaaagattttgactcacaagagaggggctggtctggaggtgggaggagggagtgacgagtcaaggaggagacagggacgcaggagggtgcaaggaagtgtcttaactgagacgggggtaaggcaagagagggtggaggaaattctgcaggagacaggcttcctccagggtctggagaacccagaggcagctcctcctgagtgctgggaaggactctgggcatcttcagcccttcttactctctgaggctcaagccagaaattcaggctgcttgcagagtgggtgacagagccacggagctggtgtccctgggaccctctgcccgtcttctctccactccccagcatggaggaaggtggtgattttgacaactactatggggcagacaaccagtctgagtgtgagtacacagactggaaatcctcgggggccctcatccctgccatctacatgttggtcttcctcctgggcaccacgggaaacggtctggtgctctggaccgtgtttcggagcagccgggagaagaggcgctcagctgatatcttcattgctagcctggcggtggctgacctgaccttcgtggtgacgctgcccctgtgggctacctacacgtaccgggactatgactggccctttgggaccttcttctgcaagctcagcagctacctcatcttcgtcaacatgtacgccagcgtcttctgcctcaccggcctcagcttcgaccgctacctggccatcgtgaggccagtggccaatgctcggctgaggctgcgggtcagcggggccgtggccacggcagttctttgggtgctggccgccctcctggccatgcctgtcatggtgttacgcaccaccggggacttggagaacaccactaaggtgcagtgctacatggactactccatggtggccactgtgagctcagagtgggcctgggaggtgggccttggggtctcgtccaccaccgtgggctttgtggtgcccttcaccatcatgctgacctgttacttcttcatcgcccaaaccatcgctggccacttccgcaaggaacgcatcgagggcctgcggaagcggcgccggctgctcagcatcatcgtggtgctggtggtgacctttgccctgtgctggatgccctaccacctggtgaagacgctgtacatgctgggcagcctgctgcactggccctgtgactttgacctcttcctcatgaacatcttcccctactgcacctgcatcagctacgtcaacagctgcctcaaccccttcctctatgcctttttcgacccccgcttccgccaggcctgcacctccatgctctgctgtggccagagcaggtgcgcaggcacctcccacagcagcagtggggagaagtcagccagctactcttcggggcacagccaggggcccggccccaacatgggcaagggtggagaacagatgcacgagaaatccatcccctacagccaggagacccttgtggttgactagggctgggagcagagagaagcctggcgccctcggccctccccggcctttgcccttgctttctgaaaatcaggtagtgtggctactccttgtcctatgcacatcctttaactgtcccctgattctgccccgccctgtcctcctctactgctttattctttctcagaggtttgtggtttaggggaaagagactgggctctacagacctgaccctgcacaagccatttaatctcactcagcctcagtttctccattggtatgaaatgggggaaagtcatattgatcctaaaatgttgaagcctgagtctggacgcagtaaaagcttgtttccctctgctgctttcttagatctgcaatcgtctttcctcccttctttccttgtagtttttcccccaccactctctgcagctgccgctccttatccctgccttctggcaccaatcccctcctacagctcgtccccctccctccatccatccttctcccctgtctactttcttgttctgaagggctactaagggttaaggatcccaaagcttgcagagactgaccctgtttaagctttctatcctgttttctgagtgtgaggcagggaatgggctggggccgggggtgggctgtgtgtcagcagataattagtgctccagcccttagatctgggagctccagagcttgccctaaaattggatcacttccctgtcattttgggcattggggctagtgtgattcctgcagttcccccatggcaccatgacactgactagatatgctttctccaaattgtccgcagaccctttcatccttcctctattttctatgagaattggaaggcagcagggctgatgaatggatgtactccttggtttcattatgtgagtggggagttgggaagggcaactagagagagaggatggaggggtgtctgcatttagtccagacactgcttggctcgctccccgagtcctcctgtttctgacttcctgcataactgtgagctgaagggtttcctcatctccccatcttaccccatcatactgatttctttcttgggcactggtgctacttggtgccaagaatcatgttgtttgggatggagatgcctgcctcttgtctgtgtgtgttgtacttatatgtctatatggatgagcctggcatgaacagcagtgtgcctgggtcatttggacaaatctcctcccaccccccaatccactgcaactctgctgttcatacattacccttggcagggggtggtggggggcagggacacactgaggcaatgaaaaatgtagaataaaaatgagtccaccccctactggatttgggggctccaacggctggtccgtgctttaggagcgaagttaatgtttgcaccaggcttcctgtagggagatccctccccaaagcagctggcgccaaggcttgggggcgtcctactgagctgggttcctgctccttcttgggctccatgaaggaagtaagaggctagttgagagcctcccttggcccctttccagtgcctccccgcctggcttcaaatttatgagcattgccctcatcgtcctttcttgttccagggtcagtggccctcttcctaaggaggcctcctgcttgccatgggccaaaaggcacggggtgggttttttctctccctaccctcaggattggacctcttggcttctgctggattggggatctgggaatagggactggagcaagtgtgcagatagcatgatgtctacactgccagagagaccgtgaggatgaaattaatagtggggcctttgtgagctagaggctgggagtgtctattccgggttttgttcttggaggactatgaaagtgaaggacaagacatgagcgatggagataagaaaagcccagcttgatgtgaatggacatcttgaccctccctggaatgacgccagacctcctctgcccagagctgtcctcaaagcatccagtgaacactggaagaggcttctagaagggaagaaattgtccctctgaggccgccgtgggtgacctgcagagacttcctgcctggaactcatctgtgaactgggacagaagcagaggaggctgcctgctgtgatacccccttacctcccccagtgccttcttcagaatatctgcactgtcttctgatcctgttagtcactgtggttcatcaaataaaactgtttgtgcaaaaaaaatgt

SEQ ID NO: 298249 - DNA, 2597 bp, Homo sapiens
gacttgcaaaaccacagataatgttcagcccagcacagtaggggtcaatttggtccacttgctcagtgacaaaaagaaaaaaaaagtgggctgtcactaaagattttgactcacaagagaggggctggtctggaggtgggaggagggagtgacgagtcaaggaggagacagggacgcaggagggtgcaaggaagtgtcttaactgagacgggggtaaggcaagagagggtggaggaaattctgcaggagacaggcttcctccagggtctggagaacccagaggcagctcctcctgagtgctgggaaggactctgggcatcttcagcccttcttactctctgaggctcaagccagaaattcaggctgcttgcagagtgggtgacagagccacggagctggtgtccctgggaccctctgcccgtcttctctccactccccagcatggaggaaggtggtgattttgacaactactatggggcagacaaccagtctgagtgtgagtacacagactggaaatcctcgggggccctcatccctgccatctacatgttggtcttcctcctgggcaccacgggaaacggtctggtgctctggaccgtgtttcggagcagccgggagaagaggcgctcagctgatatcttcattgctagcctggcggtggctgacctgaccttcgtggtgacgctgcccctgtgggctacctacacgtaccgggactatgactggccctttgggaccttcttctgcaagctcagcagctacctcatcttcgtcaacatgtacgccagcgtcttctgcctcaccggcctcagcttcgaccgctacctggccatcgtgaggccagtggccaatgctcggctgaggctgcgggtcagcggggccgtggccacggcagttctttgggtgctggccgccctcctggccatgcctgtcatggtgttacgcaccaccggggacttggagaacaccactaaggtgcagtgctacatggactactccatggtggccactgtgagctcagagtgggcctgggaggtgggccttggggtctcgtccaccaccgtgggctttgtggtgcccttcaccatcatgctgacctgttacttcttcatcgcccaaaccatcgctggccacttccgcaaggaacgcatcgagggcctgcggaagcggcgccggctgctcagcatcatcgtggtgctggtggtgacctttgccctgtgctggatgccctaccacctggtgaagacgctgtacatgctgggcagcctgctgcactggccctgtgactttgacctcttcctcatgaacatcttcccctactgcacctgcatcagctacgtcaacagctgcctcaaccccttcctctatgcctttttcgacccccgcttccgccaggcctgcacctccatgctctgctgtggccagagcaggtgcgcaggcacctcccacagcagcagtggggagaagtcagccagctactcttcggggcacagccaggggcccggccccaacatgggcaagggtggagaacagatgcacgagaaatccatcccctacagccaggagacccttgtggttgactagggctgggagcagagagaagcctggcgccctcggccctccccggcctttgcccttgctttctgaaaatcaggtagtgtggctactccttgtcctatgcacatcctttaactgtcccctgattctgccccgccctgtcctcctctactgctttattctttctcagaggtttgtggtttaggggaaagagactgggctctacagacctgaccctgcacaagccatttaatctcactcagcctcagtttctccattggtatgaaatgggggaaagtcatattgatcctaaaatgttgaagcctgagtctggacgcagtaaaagcttgtttccctctgctgctttcttagatctgcaatcgtctttcctcccttctttccttgtagtttttcccccaccactctctgcagctgccgctccttatccctgccttctggcaccaatcccctcctacagctcgtccccctccctccatccatccttctcccctgtctactttcttgttctgaagggctactaagggttaaggatcccaaagcttgcagagactgaccctgtttaagctttctatcctgttttctgagtgtgaggcagggaatgggctggggccgggggtgggctgtgtgtcagcagataattagtgctccagcccttagatctgggagctccagagcttgccctaaaattggatcacttccctgtcattttgggcattggggctagtgtgattcctgcagttcccccatggcaccatgacactgactagatatgctttctccaaattgtccgcagaccctttcatccttcctctattttctatgagaattggaaggcagcagggctgatgaatggatgtactccttggtttcattatgtgagtggggagttgggaagggcaactagagagagaggatggaggggtgattgtataaaaacttatggatttactggacagacatgtagaagatggaaatgtaacagtactgcatgcatcactaagtgccctttaaaacctggc

SEQ ID NO: 298250 - DNA, 761 bp, Homo sapiens
aagcttgcggccgccttcctgctggggatcctgtttgccctcgtctgccggagcccgcgcgcccagccgcccgacttcgccgccgcctggagccggctggccgcgacctcagccgcccgccgcccgccggggagtcctgtgtatggaaactcacatgagtcagctcagtctagaagggtagtaatttctcataatatggataaagctctgaaagaagtgttcgactacagttatagagattacattctgtcctggtatggaaacctcagcagagatgagggacaactttaccatctgctcttggaagacttttgggaaattgccagacagctgcaccacagactgagtcacgtggatgtggttaaagttgtctgcaatgatgttgtgaggactttactcactcatttctgtgacctgaaagctgccaatgccagacatgaagaacagccaagaccttttgtgttgcacgcatgcttgaggaactcagatgatgaagtaagatttctacaaacgtgttctcgggttctggtgttttgtctcctcccctcaaaggatgtgcagtctctcagcttacgtataatgcttgcagaaattctcacaacaaaagtcttgaagccggtagtggagttactgagtaatccagattacattaaccaaatgctgcttgcccagctggcgtacagagagcaaatgaatgagcatcacaagagagcctacacctatgccccctcttacgaggacttcatcaagctcattaacag

SEQ ID NO: 298251 - DNA, 649 bp, Homo sapiens
aagcttgcggccgccttcctgctggggatcctgtttgccctcgtctgccggagcccgcgcgcccagccgcccgacttcgccgccgcctggagccggctggccgcgacctcagccgcccgccgcccgccggggagtcctgtgtatggaaactcacatgagtcagctcagtctagaagggtagtaatttctcataatatggataaagctctgaaagaagtgttcgactacagttatagagattacattctgtcctggtatggaaacctcagcagagatgagggacaactttaccatctgctcttggaagacttttgggaaattgccagacagctgcaccacagactgagtcacgtggatgtggttaaagttgtctgcaatgatgttgtgaggactttactcactcatttctgtgacctgaaagctgccaatgccagacatgaagaacagccaagaccttttgtgttgcacgcatgcttgaggaactcagatgatgaatcttgaagccggtagtggagttactgagtaatccagattacattaaccaaatgctgcttgcccagctggcgtacagagagcaaatgaatgagcatcacaagagagcctacacctatgccccctcttacgaggacttcatcaagctcattaacag

SEQ ID NO: 298252 - DNA, 573 bp, Homo sapiens
acctgtactgccgaagactattcctcggcgttcctaaaggctacttcctgctagccaaagcacatttttaaaaagtgagagtcatggttcataatccatatttggcaaaaagcacaggcagtgccaagttgaatttgggtaagcagtttggcataagctatttcaacaatgaaatggccgatgtgatgatcctcagggaatacaaaaagcctcctagccattttatctgaaggctgccaatgccagacatgaagaacagccaagaccttttgtgttgcacgcatgcttgaggaactcagatgatgaagtaagatttctacaaacgtgttctcgggttctggtgttttgtctcctcccctcaaaggatgtgcagtctctcagcttacgtataatgcttgcagaaattctcacaacaaaagtcttgaagccggtagtggagttactgagtaatccagattacattaaccaaatgctgcttgcccagctggcgtacagagagcaaatgaatgagcatcacaagagagcctacacctatgccccctcttacgaggacttcatcaagctcattaacag

SEQ ID NO: 298253 - DNA, 1870 bp, Homo sapiens
cgcgagagcgccgggcggcggcgggaggaggcgcaggcgcgctgctcgcccgtctgcagccccgagccgagcgccgcgtctcgggagttgatggcagcaccactgtgcggccgcccggccgagcgcggagcgcagccactcgccgctgcccagggagcgcccaagatgtggggggaccggggcggcagcggccgtagcagcgccagggacgggggcacgcagcagcctccgctcgcccgcctgtcctgacctgcctcgcttgcccccaaagaatgtcagccaagtccaaggggaacccctcctcgtcctgtccagccgagggaccgccggcagcctccaaaaccaaggtgaaggaacagatcaagatcatcgtggaggatttggaattagtcctgggcgacctgaaggacgtggccaaggaacttaaggagatgaagtcccactctgttgcccaggctagagtgcaatggcacaatctgggctcactgcaacctctgcctcccaggttcaagctattctcctgcctcagcctgcctcagtgcgccactacgcctgggtggttgaccagattgacaccctgacctctgacctacagctggaggatgagatgactgacagctccaaaacggacacgctgaatagtagctcaagtggcacaacagcctccagcctagagaagatcaaagtgcaggctaatgcaccgcttattaaacccccagcacacccatctgctatcctcacggtcctgagaaagccaaaccctccaccacctcctccaaggttgacacctgtgaagtgtgaagaccccaaaagggtggttccaactgccaatcctgtaaaaaccaatggcacccttctacgaaatggaggcttaccaggtggacctaacaaaattccaaatggagatatctgctgcatacccaacagtaacttggacaaggctccagtccagcttctgatgcatagacctgaaaaagacagatgtccccaggcagggcctcgagaacgagttcggtttaatgaaaaagtacagtaccatggctattgtcctgactgtgatacccggtataacataaaaaacagggaggtccacttacacagtgaacctgtccacccaccgggaaagattcctcaccaaggccctcccctccctcctacaccccatctccctcctttcccactagaaaatgggggaatgggaataagccacagtaacagcttcccccctatcagacctgcaactgtgcctcctcccactgcaccaaaaccacagaagacgatcttgaggaagtcaaccactacaaccgtgtgatgtatgccattaaaaaaattgtttttttaattttctatattataaacataaaataagtaatgagcactttctactcaagcaataaaaagcccaaatatattaatcctgcattcagcaaagtggcataaaaatcacctggtaagtatgcagcacattgcttatatcctgggtatgcattattttaaatgttgtatcattaaaaacctcagaatgatgaaaaatatgaatgatgcattgtttttgcaattgacctatgacaaactgtgaacctgcagatttcacctattttgatttactataagagctgggatttgattcattttatttatgcctaagtcatctatgcattaacatgtcatattcttaactttgatctaatgctttttactaggaaattttaatactgaaggactattttattatttttttctaaagatgtttgtcactagtttttcattattaaatgctgaggccaataccaagaagtttattttctatattatacaattatgaattacatgctcagctatatatgtaataaaatactttggtctgtgg

SEQ ID NO: 298254 - DNA, 729 bp, Homo sapiens
cgcgagagcgccgggcggcggcgggaggaggcgcaggcgcgctgctcgcccgtctgcagccccgagccgagcgccgcgtctcgggagttgatggcagcaccactgtgcggccgcccggccgagcgcggagcgcagccactcgccgctgcccagggagcgcccaagatgtggggggaccggggcggcagcggccgtagcagcgccagggacgggggcacgcagcagcctccgctcgcccgcctgtcctgacctgcctcgcttgcccccaaagaatgtcagccaagtccaaggggaacccctcctcgtcctgtccagccgagggaccgccggcagcctccaaaaccaaggtgaaggaacagatcaagatcatcgtggaggatttggaattagtcctgggcgacctgaaggacgtggccaaggaacttaaggaggtgctgctgttttttcaaacgaaggaaaaggaaaaccatacagcgccacaaatgactctggacacagacagatcctggggagttacttacatgttcatctgctgtcttgtgattaaaatcatctctgtagtgaccacgtatattttcaaggactcactcttagaaacaaaaatgtcatactttcatacttcattttgtggttgtcttacattctttttctttttttttttttctctaatttaacctttatggaagctttaaagttttgtcaaaacatgagtgctttgcccatcagtga

SEQ ID NO: 298255 - DNA, 594 bp, Homo sapiens
cgcgagagcgccgggcggcggcgggaggaggcgcaggcgcgctgctcgcccgtctgcagccccgagccgagcgccgcgtctcgggagttgatggcagcaccactgtgcggccgcccggccgagcgcggagcgcagccactcgccgctgcccagggagcgcccaagatgtggggggaccggggcggcagcggccgtagcagcgccagggacgggggcacgcagcagcctccgctcgcccgcctgtcctgacctgcctcgcttgcccccaaagaatgtcagccaagtccaaggggaacccctcctcgtcctgtccagccgagggaccgccggcagcctccaaaaccaaggtgaaggaacagatcaagatcatcgtggaggatttggaattagtcctgggcgacctgaaggacgtggccaaggaacttaaggagagtcccactctgttgcccactgcactccagcccagatgacagagcaagaccttcagaagttgtgtatctaaacatacctaaacatataaaagacacagtgacaatatggtataaccttgtgggaccaccattgtataatatacgtagttccttgttaatggaa

SEQ ID NO: 298256 - DNA, 1817 bp, Homo sapiens
cgcgagagcgccgggcggcggcgggaggaggcgcaggcgcgctgctcgcccgtctgcagccccgagccgagcgccgcgtctcgggagttgatggcagcaccactgtgcggccgcccggccgagcgcggagcgcagccactcgccgctgcccagggagcgcccaagatgtggggggaccggggcggcagcggccgtagcagcgccagggacgggggcacgcagcagcctccgctcgcccgcctgtcctgacctgcctcgcttgcccccaaagaatgtcagccaagtccaaggggaacccctcctcgtcctgtccagccgagggaccgccggcagcctccaaaaccaaggtgaaggaacagatcaagatcatcgtggaggatttggaattagtcctgggcgacctgaaggacgtggccaaggaacttaaggaggtggttgaccagattgacaccctgacctctgacctacagctggaggatgagatgactgacagctccaaaacggacacgctgaatagtagctcaagtggcacaacagcctccagcctagagaagatcaaagtgcaggctaatgcaccgcttattaaacccccagcacacccatctgctatcctcacggtcctgagaaagccaaaccctccaccacctcctccaaggttgacacctgtgaagtgtgaagaccccaaaagggtggttccaactgccaatcctgtaaaaaccaatggcacccttctacgaaatggaggcttaccaggtggacctaacaaaattccaaatggagatatctgctgcatacccaacagtaacttggacaaggctccagtccagcttctgatgcatagacctgaaaaagacagatgtccccaggcagggcctcgagaacgagttcggtttaatgaaaaagtacagtaccatggctattgtcctgactgtgatacccggtataacataaaaaacagggaggtccacttacacagtgaacctgtccacccaccgggaaagattcctcaccaaggccctcccctccctcctacaccccatctccctcctttcccactagaaaatgggggaatgggaataagccacagtaacagcttcccccctatcagacctgcaactgtgcctcctcccactgcaccaaaaccacagaagacgatcttgaggaagtcaaccactacaaccgtgtgatgtatgccattaaaaaaattgtttttttaattttctatattataaacataaaataagtaatgagcactttctactcaagcaataaaaagcccaaatatattaatcctgcattcagcaaagtggcataaaaatcacctggtaagtatgcagcacattgcttatatcctgggtatgcattattttaaatgttgtatcattaaaaacctcagaatgatgaaaaatatgaatgatgcattgtttttgcaattgacctatgacaaactgtgaacctgcagatttcacctattttgatttactataagagctgggatttgattcattttatttatgcctaagtcatctatgcattaacatgtcatattcttaactttgatctaatgctttttactaggaaattttaatactgaaggactattttattatttttttctaaagatgtttgtcactagtttttcattattaaatgctgaggccaataccaagaagtttattttctatattatacaattatgaattacatgctcagctatatatgtaataaaatactttggtctgtggaaatattgttaaatcaataaacaatagtaaataatgacaaaagcaaatgttcctcagaattaaaatgaagta

SEQ ID NO: 298257 - DNA, 1566 bp, Homo sapiens
ggaaacagtgctgcaggcatacagtgacaacaggacatcaggaaatgcccaagaagtttgttaggtgctgtgtcatgaatcaagtcttcattttaatgtgttctaattgttgtaaaacaagagggaatggtatttggaatttagctatatttatcttctcaatcaaattctacttcagaggtggttgaccagattgacaccctgacctctgacctacagctggaggatgagatgactgacagctccaaaacggacacgctgaatagtagctcaagtggcacaacagcctccagcctagagaagatcaaagtgcaggctaatgcaccgcttattaaacccccagcacacccatctgctatcctcacggtcctgagaaagccaaaccctccaccacctcctccaaggttgacacctgtgaagtgtgaagaccccaaaagggtggttccaactgccaatcctgtaaaaaccaatggcacccttctacgaaatggaggcttaccaggtggacctaacaaaattccaaatggagatatctgctgcatacccaacagtaacttggacaaggctccagtccagcttctgatgcatagacctgaaaaagacagatgtccccaggcagggcctcgagaacgagttcggtttaatgaaaaagtacagtaccatggctattgtcctgactgtgatacccggtataacataaaaaacagggaggtccacttacacagtgaacctgtccacccaccgggaaagattcctcaccaaggccctcccctccctcctacaccccatctccctcctttcccactagaaaatgggggaatgggaataagccacagtaacagcttcccccctatcagacctgcaactgtgcctcctcccactgcaccaaaaccacagaagacgatcttgaggaagtcaaccactacaaccgtgtgatgtatgccattaaaaaaattgtttttttaattttctatattataaacataaaataagtaatgagcactttctactcaagcaataaaaagcccaaatatattaatcctgcattcagcaaagtggcataaaaatcacctggtaagtatgcagcacattgcttatatcctgggtatgcattattttaaatgttgtatcattaaaaacctcagaatgatgaaaaatatgaatgatgcattgtttttgcaattgacctatgacaaactgtgaacctgcagatttcacctattttgatttactataagagctgggatttgattcattttatttatgcctaagtcatctatgcattaacatgtcatattcttaactttgatctaatgctttttactaggaaattttaatactgaaggactattttattatttttttctaaagatgtttgtcactagtttttcattattaaatgctgaggccaataccaagaagtttattttctatattatacaattatgaattacatgctcagctatatatgtaataaaatactttggtctgtggaaatattgttaaatcaataaacaatagtaaataatgacaaaagcaaatgttcctcagaattaaaatgaagta

SEQ ID NO: 298258 - DNA, 766 bp, Homo sapiens
cggagcctgtcttccttctctcgtccaactctagcctccggccagctgagcctcgcttctctctagtgtgcctcctcccactgcaccaaaaccacagaagacgatcttgaggaagtcaaccactacaaccgtgtgatgtatgccattaaaaaaattgtttttttaattttctatattataaacataaaataagtaatgagcactttctactcaagcaataaaaagcccaaatatattaatcctgcattcagcaaagtggcataaaaatcacctggtaagtatgcagcacattgcttatatcctgggtatgcattattttaaatgttgtatcattaaaaacctcagaatgatgaaaaatatgaatgatgcattgtttttgcaattgacctatgacaaactgtgaacctgcagatttcacctattttgatttactataagagctgggatttgattcattttatttatgcctaagtcatctatgcattaacatgtcatattcttaactttgatctaatgctttttactaggaaattttaatactgaaggactattttattatttttttctaaagatgtttgtcactagtttttcattattaaatgctgaggccaataccaagaagtttattttctatattatacaattatgaattacatgctcagctatatatgtaataaaatactttggtctgtggaaatattgttaaatcaataaacaatagtaaataatgacaaaagcaaatgttcctcagaattaaaatgaagta

SEQ ID NO: 298259 - DNA, 3285 bp, Homo sapiens
ggcacgaggaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactggagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggttcaagctattctcctgcctcagcctcccgagtagctgggattacacggcgcacaccaccatacccagctaatttttgtatttttagtagtgaaggggttttaccatgttgggcaggctggtcttgaactcctgacctcaggtgatctgcccgcctcagcctcccacagtgctgggattacaggtatgagccaccacgcccggcccattttttttttttttttgacaacttttttttttttttgagacagggtcttgttccattgcccagactggagtgcagtggcatgatcacagctcactgcagccagtaatcctcttgcctcagcctcccaagtagttgagactacaggttgtaccactatgccctgctagttttttcattttttgtagagagacgggtcttttttttttttgagacggagtctcgctctgtcgcccaagctggagtgcagtagcacggtctcagctcattgcaagctccgcctcccaggttcacgccattctcctgcctcagactcctgtgtagctgggagtacaggcacctgccaccatgcccggctaattttttatatatttttttagcagagacagtgtctcactgtgttagtcaggatggtctcgatctcctgacctcgtgatccgcccgcctcagcctcccaaagtgctgggattacaggcgtgagccaccgcgcccagcaaggcgggtcttgctgtgtttcccagactagactggtcttgaattccagggctcaagagatctcccacctcagcctcccacagtgctgggattacaggcgtgagccgccacacccagcctattcaaaatttttttttcttagagacagggtctttgttgcccaggctggactgcagtgatacaatcatagctgactgaagcctcaaattcccaggctaaggtgatcttctcacctcagccttccaagtagctgggtccgcagatgcatgccagtacacccagctcatttaaaaaaaaatttttttcttttttgagagtcttgctttgttgcccaggctggagtgcagtggtgtgatctcggctcactgcaagctccacctcccggcttcacgccattctcctgcctcagcctcccgagtagctgggactacaggtgcccgccaccacacccggctaattttttgtatttttagtagagacggggtttcaccgtgttagccaggatggtcttgatctcctgacctcatgatccgcctgctttggcctcccaaagtgctgggattacaggcgtgagtcaccgcgcccggctcattttaaaatttttgtagatcagtgtactgttgtaaaaaaaaaaaaataagaaaaataaaaaataaatttttgtagtgataggatcccactgaggccagagaatagggtctggagacaaaggagcattcacttcagcctctgactggtggcaggccaagtctttatttacatagggtgtaaccaaataggaaacctctaaagggtacttaaaccccagattttctacacagggcacttgcttgagcctcatcccgctttctggaatgtacttttgcttcaataaatctgtgcttttgttccttcatt

SEQ ID NO: 298260 - DNA, 3323 bp, Homo sapiens
ggcacgaggaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactggagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggttcaagctattctcctgcctcagcctcccgagtagctgggattacacggcgcacaccaccatacccagctaatttttgtatttttagtagtgaaggggttttaccatgttgggcaggctggtcttgaactcctgacctcaggtgatctgcccgcctcagcctcccacagtgctgggattacaggtatgagccaccacgcccggcccattttttttttttttttgacaacttttttttttttttgagacagggtcttgttccattgcccagactggagtgcagtggcatgatcacagctcactgcagccagtaatcctcttgcctcagcctcccaagtagttgagactacaggttgtaccactatgccctgctagttttttcattttttgtagagagacgggtcttttttttttttgagacggagtctcgctctgtcgcccaagctggagtgcagtagcacggtctcagctcattgcaagctccgcctcccaggttcacgccattctcctgcctcagactcctgtgtagctgggagtacaggcacctgccaccatgcccggctaattttttatatatttttttagcagagacagtgtctcactgtgttagtcaggatggtctcgatctcctgacctcgtgatccgcccgcctcagcctcccaaagtgctgggattacaggcgtgagccaccgcgcccagcaaggcgggtcttgctgtgtttcccagactagactggtcttgaattccagggctcaagagatctcccacctcagcctcccacagtgctgggattacaggcgtgagccgccacacccagcctattcaaaatttttttttcttagagacagggtctttgttgcccaggctggactgcagtgatacaatcatagctgactgaagcctcaaattcccaggctaaggtgatcttctcacctcagccttccaagtagctgggtccgcagatgcatgccagtacacccagctcatttaaaaaaaaatttttttcttttttgagagtcttgctttgttgcccaggctggagtgcagtggtgtgatctcggctcactgcaagctccacctcccggcttcacgccattctcctgcctcagcctcccgagtagctgggactacaggtgcccgccaccacacccggctaattttttgtatttttagtagagacggggtttcaccgtgttagccaggatggtcttgatctcctgacctcatgatccgcctgctttggcctcccaaagtgctgggattacaggcgtgagtcaccgcgcccggctcattttaaaatttttgtagatcagtgtactgttgtaaaaaaaaaaaaatatagccgggtgtggtggcgggcacctgtagtcccagctactcgggaggctgaggcaggagaatggcgtgaagccgggaggtggagcttgcagtgagccgagatcacaccactgcactccagcctgggcaacaaagcaagactctcaaaaaagaaaaaaatttttttttaaatgagctgggtgtactggcatgcatctgcggacccagctacttggaaggctgaggtgagaagatcaccttagcctgggaatttgaggcttcggtcagctatgattgtatcactgcagtccgtcgacc

SEQ ID NO: 298261 - DNA, 3237 bp, Homo sapiens
ggcacgaggaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactggagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggttcaagctattctcctgcctcagcctcccgagtagctgggattacacggcgcacaccaccatacccagctaatttttgtatttttagtagtgaaggggttttaccatgttgggcaggctggtcttgaactcctgacctcaggtgatctgcccgcctcagcctcccacagtgctgggattacaggtatgagccaccacgcccggcccattttttttttttttttgacaacttttttttttttttgagacagggtcttgttccattgcccagactggagtgcagtggcatgatcacagctcactgcagccagtaatcctcttgcctcagcctcccaagtagttgagactacaggttgtaccactatgccctgctagttttttcattttttgtagagagacgggtcttttttttttttgagacggagtctcgctctgtcgcccaagctggagtgcagtagcacggtctcagctcattgcaagctccgcctcccaggttcacgccattctcctgcctcagactcctgtgtagctgggagtacaggcacctgccaccatgcccggctaattttttatatatttttttagcagagacagtgtctcactgtgttagtcaggatggtctcgatctcctgacctcgtgatccgcccgcctcagcctcccaaagtgctgggattacaggcgtgagccaccgcgcccagcaaggcgggtcttgctgtgtttcccagactagactggtcttgaattccagggctcaagagatctcccacctcagcctcccacagtgctgggattacaggcgtgagccgccacacccagcctattcaaaatttttttttcttagagacagggtctttgttgcccaggctggactgcagtgatacaatcatagctgactgaagcctcaaattcccaggctaaggtgatcttctcacctcagccttccaagtagctgggtccgcagatgcatgccagtacacccagctcatttaaaaaaaaatttttttcttttttgagagtcttgctttgttgcccaggctggagtgcagtggtgtgatctcggctcactgcaagctccacctcccggcttcacgccattctcctgcctcagcctcccgagtagctgggactacaggtgcccgccaccacacccggctaattttttgtatttttagtagagacggggtttcaccgtgttagccaggatggtcttgatctcctgacctcatgatccgccccggctcattttaaaatttttgtagatcagtgtactgttgtaaaaaaaaaaaaataagaaaaataaaaaataaatttttgtagtgataggatcccactgaggccagagaatagggtctggagacaaaggagcattcacttcagcctctgactggtggcaggccaagtctttatttacatagggtgtaaccaaataggaaacctctaaagggtacttaaaccccagattttctacacagggcacttgcttgagcctcatcccgctttctggaatgtacttttgcttcaataaatctgtgcttttgttccttcatt

SEQ ID NO: 298262 - DNA, 3150 bp, Homo sapiens
ggcacgaggaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaataaagatgccacggaggaggttgtaggctcagcctctgattttttttttcctgtgatggtgctttatgtagcagagggcaggagcgctcagcaggacgcaggctgtgcctctgcggacacttaacactaagtggtgagcgggtctagagtggagcaaggtgccctgagaagacaatagtggggtgggggcacaatcagtcaggacggcaacttggcctgtgtcaccaaatcccaagactgttttccactcctcacctctgtgactggagaaattggatactctgttcactcgatggttctaaaaactgcattgagattatgtttgtttcgggtgaattcctggacaagaccgaggatgactgccatctcctggcaagacgctcaggtagttcttttgctttaaaaggcagatattgaaaactggaattttttttttttgagtctcgctctgtcacccagactggagtgcagtggtgcaatctcggctcactgcaacctccgcctcccgggttcaagctattctcctgcctcagcctcccgagtagctgggattacacggcgcacaccaccatacccagctaatttttgtatttttagtagtgaaggggttttaccatgttgggcaggctggtcttgaactcctgacctcaggtgatctgcccgcctcagcctcccacagtgctgggattacaggtatgagccaccacgcccggcccattttttttttttttttgacaacttttttttttttttgagacagggtcttgttccattgcccagactggagtgcagtggcatgatcacagctcactgcagccagtaatcctcttgcctcagcctcccaagtagttgagactacaggttgtaccactatgccctgctagttttttcattttttgtagagagacgggtcttttttttttttgagacggagtctcgctctgtcgcccaagctggagtgcagtagcacggtctcagctcattgcaagctccgcctcccaggttcacgccattctcctgcctcagactcctgtgtagctgggagtacaggcacctgccaccatgcccggctaattttttatatatttttttagcagagacagtgtctcactgtgttagtcaggatggtctcgatctcctgacctcgtgatccgcccgcctcagcctcccaaagtgctgggattacaggcgtgagccaccgcgcccagcaaggcgggtcttgctgtgtttcccagactagactggtcttgaattccagggctcaagagatctcccacctcagcctcccacagtgctgggattacaggcgtgagccgccacacccagcctattcaaaatttttttttcttagagacagggtctttgttgcccaggctggactgcagtgatacaatcatagctgactgaagcctcaaattcccaggctaaggtgatcttctcacctcagccttccaagtagctgggtccgcagatgcatgccagtacacccagctcatttaaaaaaaaatttttttcttttttgagagtcttgctttgttgcccaggctggagtgcagtggtgtgatctcggctcactgcaagctccacctcccggcttcacgccattctcctgcctcagcctcccgagtagctgggactacaggtgcccgccaccaccccggctcattttaaaatttttgtagatcagtgtactgttgtaaaaaaaaaaaaataagaaaaataaaaaataaatttttgtagtgataggatcccactgaggccagagaatagggtctggagacaaaggagcattcacttcagcctctgactggtggcaggccaagtctttatttacatagggtgtaaccaaataggaaacctctaaagggtacttaaaccccagattttctacacagggcacttgcttgagcctcatcccgctttctggaatgtacttttgcttcaataaatctgtgcttttgttccttcatt

SEQ ID NO: 298263 - DNA, 1123 bp, Homo sapiens
  misc_feature (27)..(27): n is a, c, g, or t
aatggctattggatcgaggccgttggntgttaaattcggcagagggagtctactcaaaaatattaacttcaggataggacaggttctcagaggagtcagaccaggatgtgtcacgaccctgctgaactctggattccgtgcgacacatgacacctcaaatggtctgtaattccaagcctctgccagcgagcccaccccagcagctcttgcatgctagtataccagacctaagactgggtctatgatgttcctgacctctgaagatctctcacctcatgttgccccacaggtgctgggtattacaagtgtgtaggccgacaggtccaaccttattgccagaatgtcctatctatttgtgacatgactacgaggctgttctgtttggccatggctggactgcagtgatacaatcatagctgactgaagcctcaaattcccaggctaaggtgatcttctcacctcagccttccaagtagctgggtccgcagatgcatgccagtacacccagctcatttaaaaaaaaatttttttcttttttgagagtcttgctttgttgcccaggctggagtgcagtggtgtgatctcggctcactgcaagctccacctcccggcttcacgccattctcctgcctcagcctcccgagtagctgggactacaggtgcccgccaccacacccggctaattttttgtatttttagtagagacggggtttcaccgtgttagccaggatggtcttgatctcctgacctcatgatccgcctgctttggcctcccaaagtgctgggattacaggcgtgagtcaccgcgcccggctcattttaaaatttttgtagatcagtgtactgttgtaaaaaaaaaaaaataagaaaaataaaaaataaatttttgtagtgataggatcccactgaggccagagaatagggtctggagacaaaggagcattcacttcagcctctgactggtggcaggccaagtctttatttacatagggtgtaaccaaataggaaacctctaaagggtacttaaaccccagattttctacacagggcacttgcttgagcctcatcccgctttctggaatgtacttttgcttcaataaatctgtgcttttgttccttcatt

SEQ ID NO: 298264 - DNA, 489 bp, Homo sapiens
tcctaactttagagtctccaatttctcaactttaagtaaataattcaagactaaattctcatcatatgtagggatatttatgcagttgaagtttttattttatgaaaaattgcgttcaagatttcatcattgttttaagttacatttctttttccagggaatgttactgttatggctagtatgaattttgttccttaataacatttatatgtaagaaatagtttttaaatgataagaaaatctgattccagctatcacttgtaagagtcagtgtaagtcattgaatttcccacctactaaatcatgcaaagttccccaggctcttatgtgtctcctaggacagtcctagaggactcttcttgtcttcagtgcacactggtctcttacatgtttagtatcccagcctgtgtgatgcttggaggcatgcagctcttcttgtgtgacaaacattagctggtggtccttgccctgtccacaggtctagagaca

SEQ ID NO: 298265 - DNA, 642 bp, Homo sapiens
ggcattctggagaggtgattggagaaccatgagagcaggcagacatctgggtgagagggcacgaggggtgagtgacggcagagccagacttgctggagaggcagaaagggaaggattcaagtagcataaccaggaaatagaattgataggatttggtccctgctgacctgtggaataagggggaaggcagaggagttgattctagtatttctaagttgggccacttagtgatattggggtaccaggaacaggcttagtggacccacagaagtgaccggacccaggagtctctctgagcgcccaccctggcttctctgtgttggcttaccctttcttggttgggggtcatggggtggtcagcttcagtggtgtggtctgaggtgacaggtgctcaggagtgaggacagggagtagacatcaccaatgtgaatgtggaggtaggcaacaagagttattctagaactgacaaatttaatatattttgctgactgctgagttccatttggacaaatacctaatgcatttggggcttaaaacctagatgacgggttgaagggtacaacaaaccaccgtgatacatgtatacttatgtaacaaacctgcacgttctgcacatttgtcccagaacttaaagtaaaaaaa

SEQ ID NO: 298266 - DNA, 466 bp, Homo sapiens
ctgaagaagcaccgcatcaacagaagagaagaggagggctggactccagccggctcctgcacgtgtcttttcaattgccagccttgggttttcttatgatcctagctgctgcttatatgtttttgttattattttttaaaaactcagccatcttttccttttaaaaaataacagaatgcaaccgggcaccggtggtcacgcctgtaaccccaggactttgggaggccgaggcgggcggatcacgaggtcaggagatcgagaccatcctggctaacacggtgaaaccccgtctctactaaaaatacaaaaaaataaaaattagccgggcatggtggtgggtgcctgtagtcccagctactcgggaggctgaggcaggagaatggcatgaacccgggaggcggagcttgcagtgagccgagattgcgccactgcactccagcctgggcgacagagagagactgtctca

SEQ ID NO: 298267 - DNA, 630 bp, Homo sapiens
cttttccctcttgtaacacactcagaaaatggtggaaggggaagataaatgggaaggtcttgaactaaggagtgaggcagagtagaaggaaaagagaagatggctttcctctccctgaggtctcttgtagaaagagaagcacaatgagataaagcataagactattatagagagagatggggatttgcatgtaggaacaagcattcagtgctgagatagaggagagggctccatggagttccatcaaccttggaggagccatattggaagccagaggaatggtactccatcaattcaggtaacgcctgtcacaccaggtgggaacaagctgatggatataagaagaggtcagtaggccgggcgcggtggctcaacgtttgtaatcccagcactttgggaggctgaggcgggcagatcacgacgtcaggagattgagaccacggtgaaacctcgtctctactaaaaatacaaaaaattagccgggcatggtggtgggtgcctgtggtagtcccagctactgggagaggctgaggcaggagaatggcgtgaacctgggaggcggagcttgcagtgagccgagatcacaccactgcactccagcctgggcgacagagcgagactccatctcca

SEQ ID NO: 298268 - DNA, 4563 bp, Homo sapiens
agctgtcgcgggcagccgcctaacagcgatggcggccgagcagggccggtggcggcggcggctgcggctacggccggagacggcagtgttggcggtagtggtgggtggcaggggcctgtgaccgggagctgcccccggacccgggcaccatgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcagagctctcaaagtctgtggaaccgcctgtctgtgttgctgaatctgttgcctgctgctggtgaactccaggagtctggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggagtgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaa

SEQ ID NO: 298269 - DNA, 4559 bp, Homo sapiens
aggctggtactggtcctgggatttatgtgatccgagcagggccggtggcggcggcggctgcggctacggccggagacggcagtgttggcggtagtggtgggtggcaggggcctgtgaccgggagctgcccccggacccgggcaccatgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcagagctctcaaagtctgtggaaccgcctgtctgtgttgctgaatctgttgcctgctgctggtgaactccaggagtctggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggagtgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaa

SEQ ID NO: 298270 - DNA, 4425 bp, Homo sapiens
agctgtcgcgggcagccgcctaacagcgatggcggccgagcagggccggtggcggcggcggctgcggctacggccggagacggcagtgttggcggtagtggtgggtggcaggggcctgtgaccgggagctgcccccggacccgggcaccatgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcagagctctcaaagtctgtggaaccgcctgtctgtgttgctgaatctgttgcctgctgctggtgaactccaggagtctggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggagtgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaa

SEQ ID NO: 298271 - DNA, 4406 bp, Homo sapiens
taattggcgtcattcacatttcattcttgggcaaattagtttcccatatttacctcaaacctttcacctttatgtgtgtaacttctacccaagacattcatgaccctattcatacttgaagctcatcccttcctcctttttggaagccttcctgtgatgaccttcccgcaaggtgccatcctaggttgagggccctagccctccttttccagttccttcctgtcctatgaatgaatctgcctataagtctctgagtccctgcgtatggccacctgtgatcctctgtgtctctccctgtgtcctggatgagtgtgtctctgccctgaaagacaatgttccaagactggccctggattcttagtctctacatctcggaggggtatttcttcataggtgcgggaaggcagaagaatgggcctacaaatctctttctctttgtctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcagagctctcaaagtctgtggaaccgcctgtctgtgttgctgaatctgttgcctgctgctggtgaactccaggagtctggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggagtgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaa

SEQ ID NO: 298272 - DNA, 4101 bp, Homo sapiens
ggtgagtgatcagcaggatctggcctccactggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcagagctctcaaagtctgtggaaccgcctgtctgtgttgctgaatctgttgcctgctgctggtgaactccaggagtctggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggagtgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaa

SEQ ID NO: 298273 - DNA, 3960 bp, Homo sapiens
gaagaggtcagtaatcctctagaggaaaaagattaagctgctaatcacctgagacaaccagtgttgcctgcagacccagctgttctccctacaggttctctgatgcttagcattggttgggcctggcagctttgaatgagtattgtggccttagactgcatgaattctctttctccctaggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcagagctctcaaagtctgtggaaccgcctgtctgtgttgctgaatctgttgcctgctgctggtgaactccaggagtctggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggagtgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaa

SEQ ID NO: 298274 - DNA, 3926 bp, Homo sapiens
cgtcgacatcccccagatacaccagacatcggtgacatgccatctgtgggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcagagctctcaaagtctgtggaaccgcctgtctgtgttgctgaatctgttgcctgctgctggtgaactccaggagtctggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggagtgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaa

SEQ ID NO: 298275 - DNA, 3349 bp, Homo sapiens
ctaagggaacaaagctggaccggccccccctcgaggatcaggcccttaggcggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcagagctctcaaagtctgtggaaccgcctgtctgtgttgctgaatctgttgcctgctgctggtgaactccaggagtctggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggagtgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaa

SEQ ID NO: 298276 - DNA, 4757 bp, Homo sapiens
agctgtcgcgggcagccgcctaacagcgatggcggccgagcagggccggtggcggcggcggctgcggctacggccggagacggcagtgttggcggtagtggtgggtggcaggggcctgtgaccgggagctgcccccggacccgggcaccatgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcagagctctcaaagtctgtggaaccgcctgtctgtgttgctgaatctgttgcctgctgctggtgaactccaggagtctggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggagtgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaaaaaaaaaaacacacaaaaaaacggggggggacacaaataaccccgcaaggacacaaatacagcgaacaaatttttggcaaacggaccaacaaggagaggaacaacacacacgagcagcgacaacaaccacgacgggaaaggcacaggacaaggagaaacacacggggaggaacagcacaaccaagaaagacacg

SEQ ID NO: 298277 - DNA, 2233 bp, Homo sapiens
cggcacatggctgtctgcttcccctcccctgcagggcctggaacatcatgacctgcatcgggttggtaatggaagttgttcagagtgcagtggaagaatattttttcttccatgcctctcctcccctcattcagcagcagtgctagagagtgactttgcatgaggtcacactgagaccccaggaaaccctcttggtcttcctgatcactggagaagggaaaatacaccccaactccttacagctcattttttccctcataggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggagtgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaa

SEQ ID NO: 298278 - DNA, 1960 bp, Homo sapiens
  misc_feature (13)..(13): n is a, c, g, or t
tatcagctcggcncggttactggaccttctgccaagtatattgctggcagaaggtcatgttttcagagaactttgggagccctctagggagccaggtcccttctctgcctgaagagtgtactgaggtgagctcagatacttcctccagagccccttgtcacagcagtctgagcttatctgttttgtctttccctaccttgcccaccagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggagtgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaa

SEQ ID NO: 298279 - DNA, 4574 bp, Homo sapiens
agctgtcgcgggcagccgcctaacagcgatggcggccgagcagggccggtggcggcggcggctgcggctacggccggagacggcagtgttggcggtagtggtgggtggcaggggcctgtgaccgggagctgcccccggacccgggcaccatgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcagagctctcaaagtctgtggaaccgcctgtctgtgttgctgaatctgttgcctgctgctggtgaactccaggagtctggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggagtgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaacagacatcgtgttgttggggtaagcgagggcaaacaggaga

SEQ ID NO: 298280 - DNA, 1732 bp, Homo sapiens
  misc_feature (24)..(24): n is a, c, g, or t
  misc_feature (26)..(26): n is a, c, g, or t
  misc_feature (33)..(34): n is a, c, g, or t
  misc_feature (45)..(45): n is a, c, g, or t
taggctaggtacgaggccgggtgntnatcggcnnaggggtacctngaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggagtgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaa

SEQ ID NO: 298281 - DNA, 3865 bp, Homo sapiens
agctgtcgcgggcagccgcctaacagcgatggcggccgagcagggccggtggcggcggcggctgcggctacggccggagacggcagtgttggcggtagtggtgggtggcaggggcctgtgaccgggagctgcccccggacccgggcaccatgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcagagctctcaaagtctgtggaaccgcctgtctgtgttgctgaatctgttgcctgctgctggtgaactccaggagtctggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggagtgggttcttggatctctgaggggaaggaacagcaaaagaggcccttcttcctcacccaagatgcagggtggttggggccaggagtttggaccctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaa

SEQ ID NO: 298282 - DNA, 3576 bp, Homo sapiens
agctgtcgcgggcagccgcctaacagcgatggcggccgagcagggccggtggcggcggcggctgcggctacggccggagacggcagtgttggcggtagtggtgggtggcaggggcctgtgaccgggagctgcccccggacccgggcaccatgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcagagctctcaaagtctgtggaaccgcctgtctgtgttgctgaatctgttgcctgctgctggtgaactccaggagtctggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggagtgagaacacatggacacatggcggggaacaacacacacaggggcatgtgggatg

SEQ ID NO: 298283 - DNA, 3301 bp, Homo sapiens
agctgtcgcgggcagccgcctaacagcgatggcggccgagcagggccggtggcggcggcggctgcggctacggccggagacggcagtgttggcggtagtggtgggtggcaggggcctgtgaccgggagctgcccccggacccgggcaccatgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcagagctctcaaagtctgtggaaccgcctgtctgtgttgctgaatctgttgcctgctgctggtgaactccaggagtctggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggagtcagtggtgcgcatctgctgcatccgcagctttggtcatttcatcgcccgcctgcaaggcagcatcctgcagttcaacccagaggttggcatcttcgtcagcattgcccagtctgagcaggagagcctgctgcagcaggcccaggcacagttccgaatggcacaggaggaagctcgtcggaacaggctcatgagagacatggctcagctacgacttcagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggtaacattttagccctcacccctagaacctcaggccacctgccttgctcctccacgagcattcctagggagaacgggtagggctggataattctgaggctccacacgtagcctgccagggccctcctgcaggcctcaccttgcgaggagtacgaagttgccgcagcacctgagcttttcctctgcagatgggtcagcctctttgggccttgcgatgctcaggcttggtgttttccctcaatgcacctttgcctgctccccatatgtctccagggccagcttccagggcccactgctgctcactgccctcccagcccccagctgc

SEQ ID NO: 298284 - DNA, 621 bp, Homo sapiens
ttctgtcccagcacagcagccaagagcacgaagcacagcacctgtggggctggtgggcacaggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaa

SEQ ID NO: 298285 - DNA, 2376 bp, Homo sapiens
agctgtcgcgggcagccgcctaacagcgatggcggccgagcagggccggtggcggcggcggctgcggctacggccggagacggcagtgttggcggtagtggtgggtggcaggggcctgtgaccgggagctgcccccggacccgggcaccatgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcaggcctggccttgtgtcctgaggtccaagatcttcttgaaggttgtgaactgcctgacctcccctctagccttctgctcccagaggacatggctcttcgtaacctgcccccgctccgagctgcccacagacgctttaactttgacacggatcggcccctgctcagcaccttagaggaggtaaggatagcatttcttat

SEQ ID NO: 298286 - DNA, 1034 bp, Homo sapiens
  misc_feature (24)..(24): n is a, c, g, or t
  misc_feature (26)..(26): n is a, c, g, or t
  misc_feature (33)..(34): n is a, c, g, or t
  misc_feature (45)..(45): n is a, c, g, or t
taggctaggtacgaggccgggtgntnatcggcnnaggggtacctngaggcagagtttaaaaaaggaaacaggtacattcgctgccagaaagaggtgggaaagagctttgagcggcataagctgaagaggcaggatgcagatgcctggactctctataagatcctagacagctgcaaacagctgactctggcccagggggcaggtgaggaggatccgagtggcatggtgaccatcatcacaggccttccactggacaaccccagcgtgctttcaggccccatgcaggcagccctgcaggccgctgcccacgccagtgtggacatcaagaatgttctggacttctacaagcagtggaaggaaattggttgatactgacccccaggccctgcagtggggctgactccagatctctcctgccctccctggcagccaggaccagcacctgtagtcaccccaccacacgcagactcatgcacgcacacaggagggaggcctagctgctcagaggctgcagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggagtgggttcttggatctctgaggggaaggaacagcaaaagaggcccttcttcctcacccaagatgcagggtggttggggccaggagtttggaccctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtcaccccactcccagttgctggcagagactgagactaaagcatcacttaataaaccccccaagcccaa

SEQ ID NO: 298287 - DNA, 1869 bp, Homo sapiens
agctgtcgcgggcagccgcctaacagcgatggcggccgagcagggccggtggcggcggcggctgcggctacggccggagacggcagtgttggcggtagtggtgggtggcaggggcctgtgaccgggagctgcccccggacccgggcaccatgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctgcatccagtcagaagtgtcctttgagggagcctatgggaacctcaagcggctgtatgacaaggcagccaaaatgtaccaccaactgaagaagtgtgagactcggaaactgtctcctggcaaaaagcgatgtaaagacattaaaaggttgctagtgaactttatgtatctgcaaagcctcctacagcccaaaagcagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggatccaagcagtacagtgcagccattgccttcaccctggccctcttttcccacctcgtcaatcatgtcaacatacggctgcaggctgagctggaagagggcgagaatcccgtcccggcattccagagtgatggcacagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggatagttggcttcctgcctctctcctctaaaatagcaagtctgggaaatcctggggtgagtggagtcaccccactcccagttgctggcagagactgagactaaagcatcacttaataaaccccccaagcccaa

SEQ ID NO: 298288 - DNA, 923 bp, Homo sapiens
agctgtcgcgggcagccgcctaacagcgatggcggccgagcagggccggtggcggcggcggctgcggctacggccggagacggcagtgttggcggtagtggtgggtggcaggggcctgtgaccgggagctgcccccggacccgggcaccatgagccaaggcccccccacaggggagagcagcgagcccgaagcaaaagtcctccacactaagcggctttaccgggctgtggtggaggctgtgcatcgacttgacctcatcctttgcaacaaaactgcttatcaagaagtattcaaaccagaaaacattagcctgaggaacaagctgcgtgagctctgcgtcaagcttatgttcctgcacccagtggactatgggagaaaggctgaggagctgctgtggagaaaggtatactatgaagttatccagcttatcaagactaacaaaaagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggatgcaagaagccagtgtctgcctcagggaaggagatggattgggcacagatggcatgtcaccgatgtctggtgtatctgggggatttgtcccgatatcagaatgaattagctggcgtagataccgagctgctagccgagagattttactaccaagccctgtcagtagctcctcagattggaatgcccttcaatcagctgggcaccctggcaggcagcaagtactataatgtggaagccatgtattgctacctgcgctggtgagtatttgccagctcttttcagcttgagggagggatctctagagtcgcctcagcatca

SEQ ID NO: 298289 - DNA, 698 bp, Homo sapiens
  misc_feature (13)..(13): n is a, c, g, or t
tatcagctcggcncggttactggaccttctgccaagtatattgctggcagaaggtcatgttttcagagaactttgggagccctctagggagccaggtcccttctctgcctgaagagtgtactgaggtgagctcagatacttcctccagagccccttgtcacagcagtctgagcttatctgttttgtctttccctaccttgcccaccagtgatcgatggcctggatttgctgaagaaggaacacccaggggcccgggatgggattcggtacctggaggcagagtttaaaaaaggaaacaggtacattcgctgccagaaagaggtgggaaagagctttgagcggcataagctgaagaggcaggatgcagatgcctggtaacattttagccctcacccctagaacctcaggccacctgccttgctcctccacgagcattcctagggagaacgggtagggctggataattctgaggctccacacgtagcctgccagggccctcctgcaggcctcaccttgcgaggagtacgaagttgccgcagcacctgagcttttcctctgcagatgggtcagcctctttgggccttgcgatgctcaggcttggtgttttccctcaatgcacctttgcctgctccccatatgtctccagggccagcttccagggcccactgctgctcactgccctcccagcccccagctgc

SEQ ID NO: 298290 - DNA, 274 bp, Homo sapiens
gcagagtaacatatcctccccctgccaagactcagtagctcacctctatctcttacagcatccagtcagaagtgtcctttgagggagcctatgggaacctcaagcggctgtatgacaaggcagccaaaatgtaccaccaactgaagaagtgtgagactcggaaactgtctcctggcaaaaagcggtgagtggggcctgtgaggaggacgggttttttctgcagttggtgcagtaggaccatagggactgcgggaccattcagcatttactttgg

SEQ ID NO: 298291 - DNA, 348 bp, Homo sapiens
cccagatgtgggggagggttttctgaaacttaaaatcatcgagtttcccttcgttttctctcttgtgcagcccgatatcagaatgaattagctggcgtagataccgagctgctagccgagagattttactaccaagccctgtcagtagctcctcagattggtaagttgtccccaacttgggcctctgaatccagtagggttttcctagggaagacgatgttgttgagatggcaggcagttcatactcattttccccagctcctcttcattctcagctctctcgtacttcaccttgtttataccttttccctcttgtaacacactcagaaaatggtggaaggggaagat

SEQ ID NO: 298292 - DNA, 508 bp, Homo sapiens
tcagatgtaattaggattagggaaggaggaagagagtcagatgtaattaggattagagaaggaggggagcctggtcccagatggaaagatcagagagttagagctaagagtatgacagtaacttgtgagtgagagtagatgtagatgaagttccagagccaagtgagatgaacagggtaagggagggtgagtgcgactctgagtttattgcttaaccagccccttccctttcgcaatctgtagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggtcagtggaacctgaaaggtggacttgagcaggttctcatgcttctacctctggccttatccctcagggttcatgtagcttgcgacccagccaggcagagagagttct

SEQ ID NO: 298293 - DNA, 230 bp, Homo sapiens
gcctgggcaacaagagtgaaattccatctcaaaaacaaaacaaaatgaaaacagcaaggtccactccttagaggcctttgtgagccactacagactcaggacttcagcctaagggacatcaaaaggttttaggcaagggagtgacaatcagatgtgcattttagacaaatacaactaatcaatcaacaatagttacagagcaccaattggagcaaggcagtatagtaggc

SEQ ID NO: 298294 - DNA, 301 bp, Homo sapiens
aatcctcagctgcattttgcattatttccagagttcttggttgtaatcagtggagagacaggctgtggaagacttaccccatttcgatcaacaccaggtgaaaagggctgagttcagagcacttctcgacagatgaacatatggaggttgacaggaagggaacaaaaactcatccatgtaccaacagtggaggactccacctccacagggacaaaatctcctgtgctcaggacccttccaagtcttgccctatgtatctctttatctgtttgtatcctttgaaataaaccagtaaaccaaa

SEQ ID NO: 298295 - DNA, 2751 bp, Homo sapiens
gtagcgggcgtcccgcctgccgccgccgagacgccctgcgccttcgccttctccgcccccgggccggggcccgcgccgccgcccccgctgcccgccttccccgaggcgcccggctccgagcccgcctgctgtccgctggccttcagggtggacccgttcaccgactacggctcctcgctcaccgtcacgctgccgcccgagctgcaggcgcaccagcccttccaggtcatcctgcggtacacctcgaccgacgcccccgccatctggtggctggacccagagctgacctatggctgcgccaagcccttcgtcttcacccagggccactccgtgtgcaaccgctccttcttcccgtgcttcgacacacctgccgtgaagtgcacctactctgccgtcgtcaaggcgccatcgggggtgcaggtgctgatgagtgccacccggagtgcatacatggaggaagaaggcgtcttccacttccacatggagcaccccgtgcccgcctacctcgtggccctggtggccggagacctcaagccggcagacatcgggcccaggagccgcgtgtgggccgagccatgcctcctgcccacggccaccagcaagctgtcgggcgcagtggagcagtggctgagtgcagctgagcggctgtatgggccctacatgtggggcaggtacgacattgtcttcctgccaccctccttccccatcgtggccatggagaacccctgcctcaccttcatcatctcctccatcctggagagcgatgagttcctggtcatcgatgtcatccacgaggtggcccacagttggttcggcaacgctgtcaccaacgccacgtgggaagagatgtggctgagcgagggcctggccacctatgcccagcgccgtatcaccaccgagacctacggtgctgccttcacctgcctggagactgccttccgcctggacgccctgcaccggcagatgaagcttctgggagaggacagcccggtcagcaaactgcaggtcaagctggagccaggagtgaatcccagccacctgatgaacctgttcacctacgagaagggctactgcttcgtgtactacctgtcccagctctgcggagacccacagcgctttgatgactttctccgagcctatgtggagaagtacaagttcaccagcgtggtggcccaggacctgctggactccttcctgagcttcttcccggagctgaaggagcagagcgtggactgccgggcagggctggaattcgagcgctggctcaatgccacaggcccgccgctggctgagccggacctgtctcagggatccagcctgacccggcccgtggaggcccttttccagctgtggaccgcagaacctctggaccaggcagctgcctcggccagcgccattgacatctccaagtggaggaccttccagacagcactcttcctggaccggctcctggatgggtccccgctgccgcaggaggtggtgatgagcctgtccaagtgctactcctccctgctggactcgatgaacgctgagatccgcatccgctggctgcagattgtggtccgcaacgactactatcctgacctccacagggtgcggcgcttcctggagagccagatgtcacgcatgtacaccatcccgctgtacgaggacctctgcaccggtgccctcaagtccttcgcgctggaggtcttctaccagacgcagggccggctgcaccccaacctgcgcagagccatccagcagatcctgtcccagggcctgggctccagcacagagcccgcctcagagcccagcacggagctgggcaaggctgaagcagacacagactcggacgcacaggccctgctgcttggggacgaggcccccagcagtgccatctctctcagggacgtcaatgtgtctgcctagccctgttggcgggctgaccctcgacctcccagacaccacaattgtgccttctgtgggccaggcctgccatgactgcgtctcggctctggccatgagctctgcccaggcccacaagcccctcccctgggctctcccaggcagggagaatggggagagggacctccttgtgtctggcagagacctgtggacctggcctccccactcccagctctcttgcactgcaggccctggggccagcccgcacacaccatgcctcctgtctcaacactgacagctgtgcctagccccggatgccagcacctgccaggtgccgccccggggcaagggccccagcagccctatggtgaccgccacactgtgccttaatgtctgccgggggcccaggctgtgctgtccctgcagcacgcctccttgcagggatctgagccaccctccccgcacagccctgcaccccgcccctagggttggcagcctcagttggcccctggcagaggaacaaggacacagacattccctcagtgtggggggcaggggacacagggagaggatggttgtccctggggagggccctctggccccaggcaaccttagcccctcagaacagggagtcccaggacccagggagagtgtggggacaggacagcctgtctcttgtagcttcctggggtgggaggcacaggggcaaagcaataccccagggaaagtgggaggtggtgctggtgctctctccaggcccaccatgctgggagaggcggccagagcctggggcctccagcctgggactgctgtgatggggtatcacggtgatggtcccattaaacttccactctgcaaacctga

SEQ ID NO: 298296 - DNA, 2588 bp, Homo sapiens
  misc_feature (85)..(85): n is a, c, g, or t
  misc_feature (93)..(93): n is a, c, g, or t
  misc_feature (96)..(96): n is a, c, g, or t
tcctcctccccccaccaccccctcaccacccctcactcccaaactacggctaggtgcgaggctgggttggctgcggtcactcgancgacgccncgntcatctggtggctggacccagagctgacctatggctgcgccaagcccttcgtcttcacccagggccactccgtgtgcaaccgctccttcttcccgtgcttcgacacacctgccgtgaagtgcacctactctgccgtcgtcaaggcgccatcgggggtgcaggtgctgatgagtgccacccggagtgcatacatggaggaagaaggcgtcttccacttccacatggagcaccccgtgcccgcctacctcgtggccctggtggccggagacctcaagccggcagacatcgggcccaggagccgcgtgtgggccgagccatgcctcctgcccacggccaccagcaagctgtcgggcgcagtggagcagtggctgagtgcagctgagcggctgtatgggccctacatgtggggcaggtacgacattgtcttcctgccaccctccttccccatcgtggccatggagaacccctgcctcaccttcatcatctcctccatcctggagagcgatgagttcctggtcatcgatgtcatccacgaggtggcccacagttggttcggcaacgctgtcaccaacgccacgtgggaagagatgtggctgagcgagggcctggccacctatgcccagcgccgtatcaccaccgagacctacggtgctgccttcacctgcctggagactgccttccgcctggacgccctgcaccggcagatgaagcttctgggagaggacagcccggtcagcaaactgcaggtcaagctggagccaggagtgaatcccagccacctgatgaacctgttcacctacgagaagggctactgcttcgtgtactacctgtcccagctctgcggagacccacagcgctttgatgactttctccgagcctatgtggagaagtacaagttcaccagcgtggtggcccaggacctgctggactccttcctgagcttcttcccggagctgaaggagcagagcgtggactgccgggcagggctggaattcgagcgctggctcaatgccacaggcccgccgctggctgagccggacctgtctcagggatccagcctgacccggcccgtggaggcccttttccagctgtggaccgcagaacctctggaccaggcagctgcctcggccagcgccattgacatctccaagtggaggaccttccagacagcactcttcctggaccggctcctggatgggtccccgctgccgcaggaggtggtgatgagcctgtccaagtgctactcctccctgctggactcgatgaacgctgagatccgcatccgctggctgcagattgtggtccgcaacgactactatcctgacctccacagggtgcggcgcttcctggagagccagatgtcacgcatgtacaccatcccgctgtacgaggacctctgcaccggtgccctcaagtccttcgcgctggaggtcttctaccagacgcagggccggctgcaccccaacctgcgcagagccatccagcagatcctgtcccagggcctgggctccagcacagagcccgcctcagagcccagcacggagctgggcaaggctgaagcagacacagactcggacgcacaggccctgctgcttggggacgaggcccccagcagtgccatctctctcagggacgtcaatgtgtctgcctagccctgttggcgggctgaccctcgacctcccagacaccacaattgtgccttctgtgggccaggcctgccatgactgcgtctcggctctggccatgagctctgcccaggcccacaagcccctcccctgggctctcccaggcagggagaatggggagagggacctccttgtgtctggcagagacctgtggacctggcctccccactcccagctctcttgcactgcaggccctggggccagcccgcacacaccatgcctcctgtctcaacactgacagctgtgcctagccccggatgccagcacctgccaggtgccgccccggggcaagggccccagcagccctatggtgaccgccacactgtgccttaatgtctgccgggggcccaggctgtgctgtccctgcagcacgcctccttgcagggatctgagccaccctccccgcacagccctgcaccccgcccctagggttggcagcctcagttggcccctggcagaggaacaaggacacagacattccctcagtgtggggggcaggggacacagggagaggatggttgtccctggggagggccctctggccccaggcaaccttagcccctcagaacagggagtcccaggacccagggagagtgtggggacaggacagcctgtctcttgtagcttcctggggtgggaggcacaggggcaaagcaataccccagggaaagtgggaggtggtgctggtgctctctccaggcccaccatgctgggagaggcggccagagcctggggcctccagcctgggactgctgtgatggggtatcacggtgatggtcccattaaacttccactctgcaaacctga

SEQ ID NO: 298297 - DNA, 3110 bp, Homo sapiens
gtagcgggcgtcccgcctgccgccgccgagacgccctgcgccttcgccttctccgcccccgggccggggcccgcgccgccgcccccgctgcccgccttccccgaggcgcccggctccgagcccgcctgctgtccgctggccttcagggtggacccgttcaccgactacggctcctcgctcaccgtcacgctgccgcccgagctgcaggcgcaccagcccttccaggtcatcctgcggtacacctcgaccgacgcccccgccatctggtggctggacccagagctgacctatggctgcgccaagcccttcgtcttcacccagggccactccgtgtgcaaccgctccttcttcccgtgcttcgacacacctgccgtgaagtgcacctactctgccgtcgtcaaggcgccatcgggggtgcaggtgctgatgagtgccacccggagtgcatacatggaggaagaaggcgtcttccacttccacatggagcaccccgtgcccgcctacctcgtggccctggtggccggagacctcaagccggcagacatcgggcccaggagccgcgtgtgggccgagccatgcctcctgcccacggccaccagcaagctgtcgggcgcagtggagcagtggctgagtgcagctgagcggctgtatgggccctacatgtggggcaggtacgacattgtcttcctgccaccctccttccccatcgtggccatggagaacccctgcctcaccttcatcatctcctccatcctggagagcgatgagttcctggtcatcgatgtcatccacgaggtggcccacagttggttcggcaacgctgtcaccaacgccacgtgggaagagatgtggctgagcgagggcctggccacctatgcccagcgccgtatcaccaccgagacctacggtgctgccttcacctgcctggagactgccttccgcctggacgccctgcaccggcagatgaagcttctgggagaggacagcccggtcagcaaactgcaggtcaagctggagccaggagtgaatcccagccacctgatgaacctgttcacctacgagaagggctactgcttcgtgtactacctgtcccagctctgcggagacccacagcgctttgatgactttctccgagtgagcagccccctgcccgggacggccctgctgccatctgcccccagcccctccccggctcacagggctgcctgctcttgcggcagttggggtggaactggcaggggcctgtgagcctggctgggacctagtctgcctttctttgtggggagtgcctgggttgccacctccccttctgccaccctgtttgctcccttggcagggcctgcgtgccaagtgctggctccgcagtgcccactagctgcccctgtgcccagcacgtaccttggcgcacgccctgcagtgccctgcaggcctctggtggggctgcctgtgccccacccttccaggcctgctgaggccccacctctgccacacaggcctatgtggagaagtacaagttcaccagcgtggtggcccaggacctgctggactccttcctgagcttcttcccggagctgaaggagcagagcgtggactgccgggcagggctggaattcgagcgctggctcaatgccacaggcccgccgctggctgagccggacctgtctcagggatccagcctgacccggcccgtggaggcccttttccagctgtggaccgcagaacctctggaccaggcagctgcctcggccagcgccattgacatctccaagtggaggaccttccagacagcactcttcctggaccggctcctggatgggtccccgctgccgcaggaggtggtgatgagcctgtccaagtgctactcctccctgctggactcgatgaacgctgagatccgcatccgctggctgcagattgtggtccgcaacgactactatcctgacctccacagggtgcggcgcttcctggagagccagatgtcacgcatgtacaccatcccgctgtacgaggacctctgcaccggtgccctcaagtccttcgcgctggaggtcttctaccagacgcagggccggctgcaccccaacctgcgcagagccatccagcagatcctgtcccagggcctgggctccagcacagagcccgcctcagagcccagcacggagctgggcaaggctgaagcagacacagactcggacgcacaggccctgctgcttggggacgaggcccccagcagtgccatctctctcagggacgtcaatgtgtctgcctagccctgttggcgggctgaccctcgacctcccagacaccacaattgtgccttctgtgggccaggcctgccatgactgcgtctcggctctggccatgagctctgcccaggcccacaagcccctcccctgggctctcccaggcagggagaatggggagagggacctccttgtgtctggcagagacctgtggacctggcctccccactcccagctctcttgcactgcaggccctggggccagcccgcacacaccatgcctcctgtctcaacactgacagctgtgcctagccccggatgccagcacctgccaggtgccgccccggggcaagggccccagcagccctatggtgaccgccacactgtgccttaatgtctgccgggggcccaggctgtgctgtccctgcagcacgcctccttgcagggatctgagccaccctccccgcacagccctgcaccccgcccctagggttggcagcctcagttggcccctggcagaggaacaaggacacagacattccctcagtgtggggggcaggggacacagggagaggatggttgtccctggggagggccctctggccccaggcaaccttagcccctcagaacagggagtcccaggacccagggagagtgtggggacaggacagcctgtctcttgtagcttcctggggtgggaggcacaggggcaaagcaataccccagggaaagtgggaggtggtgctggtgctctctccaggcccaccatgctgggagaggcggccagagcctggggcctccagcctgggactgctgtgatggggtatcacggtgatggtcccattaaacttccactctgcaaacctga

SEQ ID NO: 298298 - DNA, 1941 bp, Homo sapiens
ggctctgagcagcagtcacagtggtgtgtgagtcctcagtcttccccgaggccctgccgctgcacgcccagggcatcagtacacatctggacatgtgagggacagtggcgcttggcccttgctgctcctcggagcctgaccactgcccctccctattccacgggacactggtggtttcggacgccagcccaggtgggtgttcaccttgcaggagtgaatcccagccacctgatgaacctgttcacctacgagaagggctactgcttcgtgtactacctgtcccagctctgcggagacccacagcgctttgatgactttctccgagcctatgtggagaagtacaagttcaccagcgtggtggcccaggacctgctggactccttcctgagcttcttcccggagctgaaggagcagagcgtggactgccgggcagggctggaattcgagcgctggctcaatgccacaggcccgccgctggctgagccggacctgtctcagggatccagcctgacccggcccgtggaggcccttttccagctgtggaccgcagaacctctggaccaggcagctgcctcggccagcgccattgacatctccaagtggaggaccttccagacagcactcttcctggaccggctcctggatgggtccccgctgccgcaggaggtggtgatgagcctgtccaagtgctactcctccctgctggactcgatgaacgctgagatccgcatccgctggctgcagattgtggtccgcaacgactactatcctgacctccacagggtgcggcgcttcctggagagccagatgtcacgcatgtacaccatcccgctgtacgaggacctctgcaccggtgccctcaagtccttcgcgctggaggtcttctaccagacgcagggccggctgcaccccaacctgcgcagagccatccagcagatcctgtcccagggcctgggctccagcacagagcccgcctcagagcccagcacggagctgggcaaggctgaagcagacacagactcggacgcacaggccctgctgcttggggacgaggcccccagcagtgccatctctctcagggacgtcaatgtgtctgcctagccctgttggcgggctgaccctcgacctcccagacaccacaattgtgccttctgtgggccaggcctgccatgactgcgtctcggctctggccatgagctctgcccaggcccacaagcccctcccctgggctctcccaggcagggagaatggggagagggacctccttgtgtctggcagagacctgtggacctggcctccccactcccagctctcttgcactgcaggccctggggccagcccgcacacaccatgcctcctgtctcaacactgacagctgtgcctagccccggatgccagcacctgccaggtgccgccccggggcaagggccccagcagccctatggtgaccgccacactgtgccttaatgtctgccgggggcccaggctgtgctgtccctgcagcacgcctccttgcagggatctgagccaccctccccgcacagccctgcaccccgcccctagggttggcagcctcagttggcccctggcagaggaacaaggacacagacattccctcagtgtggggggcaggggacacagggagaggatggttgtccctggggagggccctctggccccaggcaaccttagcccctcagaacagggagtcccaggacccagggagagtgtggggacaggacagcctgtctcttgtagcttcctggggtgggaggcacaggggcaaagcaataccccagggaaagtgggaggtggtgctggtgctctctccaggcccaccatgctgggagaggcggccagagcctggggcctccagcctgggactgctgtgatggggtatcacggtgatggtcccattaaacttccactctgcaaacctga

SEQ ID NO: 298299 - DNA, 3795 bp, Homo sapiens
  misc_feature (3271)..(3271): n is a, c, g, or t
gtagcgggcgtcccgcctgccgccgccgagacgccctgcgccttcgccttctccgcccccgggccggggcccgcgccgccgcccccgctgcccgccttccccgaggcgcccggctccgagcccgcctgctgtccgctggccttcagggtggacccgttcaccgactacggctcctcgctcaccgtcacgctgccgcccgagctgcaggcgcaccagcccttccaggtcatcctgcggtacacctcgaccgacgcccccgccatctggtggctggacccagagctgacctatggctgcgccaagcccttcgtcttcacccagggccactccgtgtgcaaccgctccttcttcccgtgcttcgacacacctgccgtgaagtgcacctactctgccgtcgtcaaggcgccatcgggggtgcaggtgctgatgagtgccacccggagtgcatacatggaggaagaaggcgtcttccacttccacatggagcaccccgtgcccgcctacctcgtggccctggtggccggagacctcaagccggcagacatcgggcccaggagccgcgtgtgggccgagccatgcctcctgcccacggccaccagcaagctgtcgggcgcagtggagcagtggctgagtgcagctgagcggctgtatgggccctacatgtggggcaggtacgacattgtcttcctgccaccctccttccccatcgtggccatggagaacccctgcctcaccttcatcatctcctccatcctggagagcgatgagttcctggtcatcgatgtcatccacgaggtggcccacagttggttcggcaacgctgtcaccaacgccacgtgggaagagatgtggctgagcgagggcctggccacctatgcccagcgccgtatcaccaccgagacctacggtgctgccttcacctgcctggagactgccttccgcctggacgccctgcaccggcagatgaagcttctgggagaggacagcccggtcagcaaactgcaggtcaagctggagccaggagtgaatcccagccacctgatgaacctgttcacctacgagaagggctactgcttcgtgtactacctgtcccagctctgcggagacccacagcgctttgatgactttctccgagcctatgtggagaagtacaagttcaccagcgtggtggcccaggacctgctggactccttcctgagcttcttcccggagctgaaggagcagagcgtggactgccgggcagggctggaattcgagcgctggctcaatgccacaggcccgccgctggctgagccggacctgtctcagggatccagcctgacccggcccgtggaggcccttttccagctgtggaccgcagaacctctggaccaggcagctgcctcggccagcgccattgacatctccaagtggaggaccttccagacagcactcttcctggaccggctcctggatgggtccccgctgccgcaggaggtggtgatgagcctgtccaagtgctactcctccctgctggactcgatgaacgctgagatccgcatccgctggctgcagattgtggtccgcaacgactactatcctgacctccacagggtgcggcgcttcctggagagccagatgtcacgcatgtacaccatcccgctgtacgaggacctctgcaccggtgccctcaagtccttcgcgctggaggtcttctaccagacgcagggccggctgcaccccaacctgcgcagagccatccagcagatcctgtcccagggcctgggctccagcacagagcccgcctcagagcccagcacggagctgggcaaggctgaagcagacacagactcggacgcacaggccctgctgcttggggacgaggcccccagcagtgccatctctctcagggacgtcaatgtgtctgcctagccctgttggcgggctgaccctcgacctcccagacaccacaattgtgccttctgtgggccaggcctgccatgactgcgtctcggctctggccatgagctctgcccaggcccacaagcccctcccctgggctctcccaggcagggagaatggggagagggacctccttgtgtctggcagagacctgtggacctggcctccccactcccagctctcttgcactgcaggccctggggccagcccgcacacaccatgcctcctgtctcaacactgacagctgtgcctagccccggatgccagcacctgccaggtgccgccccggggcaagggccccagcagccctatggtgaccgccacactgtgccttaatgtctgccgggggcccaggctgtgctgtccctgcagcacgcctccttgcagggatctgagccaccctccccgcacagccctgcaccccgcccctagggttggcagcctcagttggcccctggcagaggaacaaggacacagacattccctcagtgtggggggcaggggacacagggagaggatggttgtccctggggagggccctctggccccaggcaaccttagcccctcagaacagggagtcccaggacccagggagagtgtggggacaggacagcctgtctcttgtagcttcctggggtgggaggcacaggggcaaagcaataccccagggaaagtgggaggtggtgctggtgctctctccaggcccaccatgctgggagaggcggccagagcctggggcctccagcctgggactgctgtgatggggtatcacggtgatggtcccattaaacttccactctgcaaacctgaaaaaaaaaaaaaaaaaaaaaaaaaaagaaaaaaaagaaataaagaagaaaaacaaaaaaaagaaacaaaaaaaaaaaaaaggagggggcgcggcgccataagaaaaatctcccgcgagcggcgaccgacgatatcgacggagctcaccgcgtttttgtgggtaaaagagggcgccccaatggagggccgtctcattaatacgagacgagggagcgagacggcagataacacaccgggcacgcggacgggaaccaactgagcgccgaggaactatggagaggacgcaccccatacgcgctggggaggggcggcaactacgtggcgaacaaccacttcatcgagagagtttaagactcctgacgaggagaaatataacaagtgatacgaggttgttagttggctggtacacccacgaggcagaattaattcctgaggagagaaagaacgttcgtgctacgaacgggagaaattagttctacagagacaaatttttcccgcgagacttagtattaaaattacncacgagagtaagagtaaaacagtgaagagagagagacagcgagagagcagaaaacgagaagagaacagaagagagcaaacagagggagaagagaggacagacggatggtgacgacgagaagcgacacaagcacagcgaacagaagcagaggagcgagagagaagaacagagcacagggcggaagagcgcaaagcaacaaccgacaagaccaccaagaaaacagcgcaagacacaagacaacacgagcagcgagagacgcaagacgagtagcacaaagacaaagagcagagaagaagcacacgcgaacgccacggagaggcagagagagtcagcgacacgcagacgacaggaagcaagagaggaataatagccagcagccacagcgcagtgagacagtagaacggaacacagacggagcgacgaagacagagcgcgaagacgtagagcaacagaagagaaggatagcagagtaaaagatccaggcagagcagcagaccagagcagagagcacagcgtgcagagtc

SEQ ID NO: 298300 - DNA, 2718 bp, Homo sapiens
gtagcgggcgtcccgcctgccgccgccgagacgccctgcgccttcgccttctccgcccccgggccggggcccgcgccgccgcccccgctgcccgccttccccgaggcgcccggctccgagcccgcctgctgtccgctggccttcagggtggacccgttcaccgactacggctcctcgctcaccgtcacgctgccgcccgagctgcaggcgcaccagcccttccaggtcatcctgcggtacacctcgaccgacgcccccgccatctggtggctggacccagagctgacctatggctgcgccaagcccttcgtcttcacccagggccactccgtgtgcaaccgctccttcttcccgtgcttcgacacacctgccgtgaagtgcacctactctgccgtcgtcaaggcgccatcgggggtgcaggtgctgatgagtgccacccggagtgcatacatggaggaagaaggcgtcttccacttccacatggagcaccccgtgcccgcctacctcgtggccctggtggccggagacctcaagccggcagacatcgggcccaggagccgcgtgtgggccgagccatgcctcctgcccacggccaccagcaagctgtcgggcgcagtggagcagtggctgagtgcagctgagcggctgtatgggccctacatgtggggcaggtacgacattgtcttcctgccaccctccttccccatcgtggccatggagaacccctgcctcaccttcatcatctcctccatcctggagagcgatgagttcctggtcatcgatgtcatccacgaggtggcccacagttggttcggcaacgctgtcaccaacgccacgtgggaagagatgtggctgagcgagggcctggccacctatgcccagcgccgtatcaccaccgagacctacggtgctgccttcacctgcctggagactgccttccgcctggacgccctgcaccggcagatgaagcttctgggagaggacagcccggtcagcaaactgcaggtcaagctggagccaggagtgaatcccagccacctgatgaacctgttcacctacgagaagggctactgcttcgtgtactacctgtcccagctctgcggagacccacagcgctttgatgactttctccgagcctatgtggagaagtacaagttcaccagcgtggtggcccaggacctgctggactccttcctgagcttcttcccggagctgaaggagcagagcgtggactgccgggcaggcccgccgctggctgagccggacctgtctcagggatccagcctgacccggcccgtggaggcccttttccagctgtggaccgcagaacctctggaccaggcagctgcctcggccagcgccattgacatctccaagtggaggaccttccagacagcactcttcctggaccggctcctggatgggtccccgctgccgcaggaggtggtgatgagcctgtccaagtgctactcctccctgctggactcgatgaacgctgagatccgcatccgctggctgcagattgtggtccgcaacgactactatcctgacctccacagggtgcggcgcttcctggagagccagatgtcacgcatgtacaccatcccgctgtacgaggacctctgcaccggtgccctcaagtccttcgcgctggaggtcttctaccagacgcagggccggctgcaccccaacctgcgcagagccatccagcagatcctgtcccagggcctgggctccagcacagagcccgcctcagagcccagcacggagctgggcaaggctgaagcagacacagactcggacgcacaggccctgctgcttggggacgaggcccccagcagtgccatctctctcagggacgtcaatgtgtctgcctagccctgttggcgggctgaccctcgacctcccagacaccacaattgtgccttctgtgggccaggcctgccatgactgcgtctcggctctggccatgagctctgcccaggcccacaagcccctcccctgggctctcccaggcagggagaatggggagagggacctccttgtgtctggcagagacctgtggacctggcctccccactcccagctctcttgcactgcaggccctggggccagcccgcacacaccatgcctcctgtctcaacactgacagctgtgcctagccccggatgccagcacctgccaggtgccgccccggggcaagggccccagcagccctatggtgaccgccacactgtgccttaatgtctgccgggggcccaggctgtgctgtccctgcagcacgcctccttgcagggatctgagccaccctccccgcacagccctgcaccccgcccctagggttggcagcctcagttggcccctggcagaggaacaaggacacagacattccctcagtgtggggggcaggggacacagggagaggatggttgtccctggggagggccctctggccccaggcaaccttagcccctcagaacagggagtcccaggacccagggagagtgtggggacaggacagcctgtctcttgtagcttcctggggtgggaggcacaggggcaaagcaataccccagggaaagtgggaggtggtgctggtgctctctccaggcccaccatgctgggagaggcggccagagcctggggcctccagcctgggactgctgtgatggggtatcacggtgatggtcccattaaacttccactctgcaaacctga

SEQ ID NO: 298301 - DNA, 2017 bp, Homo sapiens
gtagcgggcgtcccgcctgccgccgccgagacgccctgcgccttcgccttctccgcccccgggccggggcccgcgccgccgcccccgctgcccgccttccccgaggcgcccggctccgagcccgcctgctgtccgctggccttcagggtggacccgttcaccgactacggctcctcgctcaccgtcacgctgccgcccgagctgcaggcgcaccagcccttccaggtcatcctgcggtacacctcgaccgacgcccccgccatctggtggctggacccagagctgacctatggctgcgccaagcccttcgtcttcacccagggccactccgtgtgcaaccgctccttcttcccgtgcttcgacacacctgccgtgaagtgcacctactctgccgtcgtcaaggcgccatcgggggtgcaggtgctgatgagtgccacccggagtgcatacatggaggaagaaggcgtcttccacttccacatggagcaccccgtgcccgcctacctcgtggccctggtggccggagacctcaagccggcagacatcgggcccaggagccgcgtgtgggccgagccatgcctcctgcccacggccaccagcaagctgtcgggcgcagtggagcagtggctgagtgcagctgagcggctgtatgggccctacatgtggggcaggtacgacattgtcttcctgccaccctccttccccatcgtggccatggagaacccctgcctcaccttcatcatctcctccatcctggagagcgatgagttcctggtcatcgatgtcatccacgaggtggcccacagttggttcggcaacgctgtcaccaacgccacgtgggaagagatgtggctgagcgagggcctggccacctatgcccagcgccgtatcaccaccgagacctacggtgctgccttcacctgcctggagactgccttccgcctggacgccctgcaccggcagatgaagcttctgggagaggacagcccggtcagcaaactgcaggtcaagctggagccaggagtgaatcccagccacctgatgaacctgttcacctacgagaagggctactgcttcgtgtactacctgtcccagctctgcggagacccacagcgctttgatgactttctccgagcctatgtggagaagtacaagttcaccagcgtggtggcccaggacctgctggactccttcctgagcttcttcccggagctgaaggagcagagcgtggactgccgggcagggctggaattcgagcgctggctcaatgccacaggcccgccgctggctgagccggacctgtctcagggatccagcctgacccggcccgtggaggcccttttccagctgtggaccgcagaacctctggaccaggcagctgcctcggccagcgccattgacatctccaagtggaggaccttccagacagcactcttcctggaccggctcctggatgggtccccgctgccgcaggaggtggtgatgagcctgtccaagtgctactcctccctgctggactcgatgaacgctgagatccgcatccgctggctgcagattgtggtccgcaacgactactatcctgacctccacagggtgcggcgcttcctggagagccagatgtcacgcatgtacaccatcccgctgtacgaggacctctgcaccggtgccctcaagtccttcgcgctggaggtcttctaccagacgcagggggacacagggagaggatggttgtccctggggagggccctctggccccaggcaaccttagcccctcagaacagggagtcccaggacccagggagagtgtggggacaggacagcctgtctcttgtagcttcctggggtgggaggcacaggggcaaagcaataccccagggaaagtgggaggtggtgctggtgctctctccaggcccaccatgctgggagaggcggccagagcctggggcctccagcctgggactgctgtgatggggtatcacggtgatggtcccattaaacttccactctgcaaacctga

SEQ ID NO: 298302 - DNA, 1409 bp, Homo sapiens
gtagcgggcgtcccgcctgccgccgccgagacgccctgcgccttcgccttctccgcccccgggccggggcccgcgccgccgcccccgctgcccgccttccccgaggcgcccggctccgagcccgcctgctgtccgctggccttcagggtggacccgttcaccgactacggctcctcgctcaccgtcacgctgccgcccgagctgcaggcgcaccagcccttccaggtcatcctgcggtacacctcgaccgacgcccccgccatctggtggctggacccagagctgacctatggctgcgccaagcccttcgtcttcacccagggccactccgtgtgcaaccgctccttcttcccgtgcttcgacacacctgccgtgaagtgcacctactctgccgtcgtcaaggcgccatcgggggtgcaggtgctgatgagtgccacccggagtgcatacatggaggaagaaggcgtcttccacttccacatggagcaccccgtgcccgcctacctcgtggccctggtggccggagacctcaagccggcagacatcgggcccaggagccgcgtgtgggccgagccatgcctcctgcccacggccaccagcaagctgtcgggcgcagtggagcagtggctgagtgcagctgagcggctgtatgggccctacatgtggggcaggtacgacattgtcttcctgccaccctccttccccatcgtggccatggagaacccctgcctcaccttcatcatctcctccatcctggagagcgatgagttcctggtcatcgatgtcatccacgaggtggcccacagttggttcggcaacgctgtcaccaacgccacgtgggaagagatgtggctgagcgagggcctggccacctatgcccagcgccgtatcaccaccgagacctacggtgctgccttcacctgcctggagactgccttccgcctggacgccctgcaccggcagatgaagcttctgggagaggacagcccggtcagcaaactgcaggtcaagctggagccaggagtgaatcccagccacctgatgaacctgttcacctacgagaagggctactgcttcgtgtactacctgtcccagctctgcggagacccacagcgctttgatgactttctccgagcctatgtggagaagtacaagttcaccagcgtggtggcccaggacctgctggactccttcctgagcttcttcccggagctgaaggagcagagcgtggactgccgggcaggtgaggctgacccccaaccctgcagccagggagccgtgggtatgatggcaggcggggcctctgctgcctgaggggccactccacctggaggaaagccctgtcagttcactgtctgtccttcagccaacccttgctggaccatgtgggccccaggctggtatgctat

SEQ ID NO: 298303 - DNA, 1334 bp, Homo sapiens
gtagcgggcgtcccgcctgccgccgccgagacgccctgcgccttcgccttctccgcccccgggccggggcccgcgccgccgcccccgctgcccgccttccccgaggcgcccggctccgagcccgcctgctgtccgctggccttcagggtggacccgttcaccgactacggctcctcgctcaccgtcacgctgccgcccgagctgcaggcgcaccagcccttccaggtcatcctgcggtacacctcgaccgacgcccccgccatctggtggctggacccagagctgacctatggctgcgccaagcccttcgtcttcacccagggccactccgtgtgcaaccgctccttcttcccgtgcttcgacacacctgccgtgaagtgcacctactctgccgtcgtcaaggcgccatcgggggtgcaggtgctgatgagtgccacccggagtgcatacatggaggaagaaggcgtcttccacttccacatggagcaccccgtgcccgcctacctcgtggccctggtggccggagacctcaagccggcagacatcgggcccaggagccgcgtgtgggccgagccatgcctcctgcccacggccaccagcaagctgtcgggcgcagtggagcagtggctgagtgcagctgagcggctgtatgggccctacatgtggggcaggtacgacattgtcttcctgccaccctccttccccatcgtggccatggagaacccctgcctcaccttcatcatctcctccatcctggagagcgatgagttcctggtcatcgatgtcatccacgaggtggcccacagttggttcggcaacgctgtcaccaacgccacgtgggaagagatgtggctgagcgagggcctggccacctatgcccagcgccgtatcaccaccgagacctacggtgctgccttcacctgcctggagactgccttccgcctggacgccctgcaccggcagatgaagcttctgggagaggacagcccggtcagcaaactgcaggtcaagctggagccaggagtgaatcccagccacctgatgaacctgttcacctacgagaagggctactgcttcgtgtactacctgtcccagctctgcggagacccacagcgctttgatgactttctccgagcctatgtggagaagtacaagttcaccagcgtggtggcccaggacctgctggactccttcctgagcttcttcccggagctgaaggagcagagcgtggactgccgggcaggctggaattcgagcgctggctcaatgccacgggccgggtcaggctggatccctgagacaggtccggctcagccagcggcgggcgtcgacgc

SEQ ID NO: 298304 - DNA, 798 bp, Homo sapiens
ccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaagtgaggaatgtgtttactgtgtacatggtttactagaaatgtttattgattatatttccagctttaattttcttgagtaatttaactgaatttacacagtttgcttcattgtattttcaaacaaatagaaaataaacttattaggaagcattttcttaaagtgtttcttgctgtcttttctatctgctctaatgttttggtccttttattgagtttttattgcttttgatgtcagggcttatttaatctctagtgcatgaaagtctcatatgtaaaaaatgattattctgaatttaatctgtcattggtcatatttctaagtgttcaaccttataaaaaaaataaatgactatcaaaaaag

SEQ ID NO: 298305 - DNA, 598 bp, Homo sapiens
agaggggggttaattttttcccccacaaaaaaaaaaaaaaaaggtttttttttggggaaatagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactggg

SEQ ID NO: 298306 - DNA, 365 bp, Homo sapiens
  misc_feature (1)..(1): n is a, c, g, or t
ntacaggatccccttattcgtgttgcacggcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttagttattcagaggctgctctgctgagaagatgaacaaatttcttgtccaaaacaatgtatttcaaacgtgccgctcgggcctttcccgtattgctcactggtgcaacacgaataagatcactgga

SEQ ID NO: 298307 - DNA, 1915 bp, Homo sapiens
ccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaacatttagcagaagagaaacctgatggccttatcaatgaagctactaggcaagttgctttggcagatgccattctcattaataaaacagacttggttccagaagaagatgtaaagaaattaagagcgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcggtactgtaaaacatttaacattcatacagttatatataatatccttttttttaaagaatggtatttcacaaaaatgtcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacctgatcacctggctgaaggagtgtttgtcaggtttctccattgtaaagttactcttttcccccatttcatactgtgctctttggaaggaaatcactatgcacagcccacactaaaggaatggggagttgtagtgtacttttttgggagtggtctacataattaattgaaattcttctgcaaagg

SEQ ID NO: 298308 - DNA, 1785 bp, Homo sapiens
ccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaacatttagcagaagagaaacctgatggccttatcaatgaagctactaggcaagttgctttggcagatgccattctcattaataaaacagacttggttccagaagaagatgtaaagaaattaagagcgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaaggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcggtactgtaaaacatttaacattcatacagttatatataatatccttttttttaaagaatggtatttcacaaaaatgtcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacctgatcacctggctgaaggagtgtttgtcaggtttctccattgtaaagttactcttttcccccatttcatactgtgctctttggaaggaaatcactatgcacagcccacactaaaggaatggggagttgtagtgtacttttttgggagtggtctacataattaattgaaattcttctgcaaagg

SEQ ID NO: 298309 - DNA, 1342 bp, Homo sapiens
ccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaacatttagcagaagagaaacctgatggccttatcaatgaagctactaggcaagttgctttggcagatgccattctcattaataaaacagacttggttccagaagaagatgtaaagaaattaagagcgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactggg

SEQ ID NO: 298310 - DNA, 1415 bp, Homo sapiens
ccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaacatttagcagaagagaaacctgatggccttatcaatgaagctactaggcaagttgctttggcagatgccattctcattaataaaacagacttggttccagaagaagatgtaaagaaattaagagcgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggacacacaacacaaaaaaaaagggccgaagcattcaacagaacccctcaaggggccgagtttccgcgtacccag

SEQ ID NO: 298311 - DNA, 1729 bp, Homo sapiens
ccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaacatttagcagaagagaaacctgatggccttatcaatgaagctactaggcaagttgctttggcagatgccattctcattaataaaacagacttggttccagaagaagatgtaaagaaattaagagcgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggtaagtctgaaaggattcacagttttaaaacaaagtgaaaaatatatttgaaagggatatcatgtgccactcaaacagattaaccattcaggtcctcttttaaaactaaataagcttgtggtcaatgtttcatctttatcacgttacaacgttcgtaaaagcttgttaggacttttgttcttcttcagttttagaaaagtggttaatccaaggaccaatgtgactttgatgtactgacctggaaagttaaagatggaatcactcaattactattctttttgtaaatttctaaacaccataaagcatttaatgaactggaattgataggtgaactgtgtcattttaataagcataatgtaatcacgtcatattttgttttgtttgcaggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactggg

SEQ ID NO: 298312 - DNA, 2139 bp, Homo sapiens
ccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaagcaaagaattggacaacttaaaatgacagctctctattctgaggacttgacacccaggctactgacattgttcttttcggttctacaaatgtgacagcatttaatgcaatagaagcaatgaatgaagttacccagagaagcatttagcagaagagaaacctgatggccttatcaatgaagctactaggcaagttgctttggcagatgccattctcattaataaaacagacttggttccagaagaagatgtaaagaaattaagagcgacaattagatccataaatggactaggacaaatcttagaaacacaaagatcaagaacaataaacatgcagtgattgatttttcttacttcaagtggatgagtgagcaagtgactaaaatcttccgtgaattcttcagtagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcggtactgtaaaacatttaacattcatacagttatatataatatccttttttttaaagaatggtatttcacaaaaatgtcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacctgatcacctggctgaaggagtgtttgtcaggtttctccattgtaaagttactcttttcccccatttcatactgtgctctttggaaggaaatcactatgcacagcccacactaaaggaatggggagttgtagtgtacttttttgggagtggtctacataattaattgaaattcttctgcaaagg

SEQ ID NO: 298313 - DNA, 2013 bp, Homo sapiens
ccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttagttattcagaggctgctctgctgagaagatgaacaaatttcttgtccaaaacaatgtatttcaaacgtgccgctcgggcctttcccgtattgctcactggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaacatttagcagaagagaaacctgatggccttatcaatgaagctactaggcaagttgctttggcagatgccattctcattaataaaacagacttggttccagaagaagatgtaaagaaattaagagcgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcggtactgtaaaacatttaacattcatacagttatatataatatccttttttttaaagaatggtatttcacaaaaatgtcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacctgatcacctggctgaaggagtgtttgtcaggtttctccattgtaaagttactcttttcccccatttcatactgtgctctttggaaggaaatcactatgcacagcccacactaaaggaatggggagttgtagtgtacttttttgggagtggtctacataattaattgaaattcttctgcaaagg

SEQ ID NO: 298314 - DNA, 2237 bp, Homo sapiens
ccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttagttattcagaggctgctctgctgagaagatgaacaaatttcttgtccaaaacaatgtatttcaaacgtgccgctcgggcctttcccgtattgctcactggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaagcaaagaattggacaacttaaaatgacagctctctattctgaggacttgacacccaggctactgacattgttcttttcggttctacaaatgtgacagcatttaatgcaatagaagcaatgaatgaagttacccagagaagcatttagcagaagagaaacctgatggccttatcaatgaagctactaggcaagttgctttggcagatgccattctcattaataaaacagacttggttccagaagaagatgtaaagaaattaagagcgacaattagatccataaatggactaggacaaatcttagaaacacaaagatcaagaacaataaacatgcagtgattgatttttcttacttcaagtggatgagtgagcaagtgactaaaatcttccgtgaattcttcagtagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcggtactgtaaaacatttaacattcatacagttatatataatatccttttttttaaagaatggtatttcacaaaaatgtcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacctgatcacctggctgaaggagtgtttgtcaggtttctccattgtaaagttactcttttcccccatttcatactgtgctctttggaaggaaatcactatgcacagcccacactaaaggaatggggagttgtagtgtacttttttgggagtggtctacataattaattgaaattcttctgcaaagg

SEQ ID NO: 298315 - DNA, 1899 bp, Homo sapiens
ccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaagacaatggccttgagagctgaattgagaatgttgattactatgactgtgtagagaccactgtgatgggagacccaggtgcagtggcttctatgttttgggttgatgctgaattagggagtgatatttaccttgatggtatcataactatagtggattcaaaatatggattaaaacatttagcagaagagaaacctgatggccttatcaatgaagctactaggcaagttgctttggcagatgccattctcattaataaaacagacttggttccagaagaagatgtaaagaaattaagagcgacaattagatccataaatggactaggacaaatcttagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcggtactgtaaaacatttaacattcatacagttatatataatatccttttttttaaagaatggtatttcacaaaaatgtcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacctgatcacctggctgaaggagtgtttgtcaggtttctccattgtaaagttactcttttcccccatttcatactgtgctctttggaaggaaatcactatgcacagcccacactaaaggaatggggagttgtagtgtacttttttgggagtggtctacataattaattgaaattcttctgcaaagg

SEQ ID NO: 298316 - DNA, 1150 bp, Homo sapiens
ggctgcaggaattcggcacgagagaaacacaaagatcaagagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcggtactgtaaaacatttaacattcatacagttatatataatatccttttttttaaagaatggtatttcacaaaaatgtcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacctgatcacctggctgaaggagtgtttgtcaggtttctccattgtaaagttactcttttcccccatttcatactgtgctctttggaaggaaatcactatgcacagcccacactaaaggaatggggagttgtagtgtacttttttgggagtggtctacataattaattgaaattcttctgcaaagg

SEQ ID NO: 298317 - DNA, 1759 bp, Homo sapiens
tacgaagtatgtggtagggtggggggcatccatatagtcactccaggtttatggagggttcttctactattaggacttttcgcttcgaagcgaaggcttctcaaatcatgaaaattattaatattactgctgttagagaaatgaatgggtgcagtggcttctatgttttgggttgatgctgaattagggagtgatatttaccttgatggtatcataactatagtggattcaaaatatggattaaaagcaaagaattggacaacttaaaatgacagctctctattctgaggacttgacacccaggctactgacattgttcttttcggttctacaaatgtgacagcatttaatgcaatagaagcaatgaatgaagttacccagagaagcatttagcagaagagaaacctgatggccttatcaatgaagctactaggcaagttgctttggcagatgccattctcattaataaaacagacttggttccagaagaagatgtaaagaaattaagagcgacaattagatccataaatggactaggacaaatcttagaaacacaaagatcaagaacaataaacatgcagtgattgatttttcttacttcaagtggatgagtgagcaagtgactaaaatcttccgtgaattcttcagtagttgatctctctaatgtattagatcttcatgcctttgatagtctctctggaataagtttgcagaaaaaacttcagcatgtgccaggaacacaacctcaccttgatcagagtattgttacaatcacatttgaagtaccaggaaatgcaaaggaagaacatcttaatatgtttattcagaatctcctgtgggaaaagaatgtgagaaacaaggacaatcactgcatggaggtcataaggctgaagggattggtgtcaatcaaagacaaatcacaacaagtgattgtccagggtgtccatgagctctatgatctggaggagactccagtgagctggaaggatgacactgagagaacaaatcgattggtcctccttggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcggtactgtaaaacatttaacattcatacagttatatataatatccttttttttaaagaatggtatttcacaaaaatgtcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacctgatcacctggctgaaggagtgtttgtcaggtttctccattgtaaagttactcttttcccccatttcatactgtgctctttggaaggaaatcactatgcacagcccacactaaaggaatggggagttgtagtgtacttttttgggagtggtctacataattaattgaaattcttctgcaaagg

SEQ ID NO: 298318 - DNA, 923 bp, Homo sapiens
ccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaaggacaatggccttagagctattgagaatttgatgcaaaagaaggggaaatttgattacatactgttagagaccactggattggcagacccaggtgcagtggcttctatgttttgggttgatgctgaattagggagtgatatttaccttgatggtatcataactatagtggattcaaaatatggattaaaacatttagcagaagagaaacctgatggccttatcaatgaagctactaggcaagttgctttggcagatggctcgtcgttgtatcacaggagggatcgtggaagaataccaattgccatattacaacatggtaccgagtgatccgtcatacgaagatatgcgtgaggttgtgtgtgtcaaacgtttgcggccaattgtgtctaatcggtggaacagtgatgaatgtctacgagcagttttgaagctaatgtcagaatgctgggcccacaactccagcctccagactcacagctttgacga

SEQ ID NO: 298319 - DNA, 1681 bp, Homo sapiens
catttctaaaacaaattatttaatataatcaaactcctttaacttctcaacttttcccactaaaactgtgaaacattatataaaatctttaatcaataggatatgatacatatttcatcattttgtttcaggttttggttgtgataaataacactgaaaaaccatcctaatatatgtattaactttatcattagaaaaggggattgttcaaaaaaaaaatcaatacacagaaaccttttttgaaaattaaaaacattaagaaacttcttgtaattcacaaataattggaattaagtaattttctcagcttaagagtttgtattttttaagtgaatatcagtaattaatccattaacattgatgctctatttctgcttttaagtttgaactgaggctgattaatgttcagtcaattctcctttgagcagggattggtgtcaatcaaagacaaatcacaacaagtgattgtccagggtgtccatgagctctatgatctggaggagactccagtgagctggaaggatgacactgagagaacaaatcgattggtcctccttggtaagtctgaaaggattcacagttttaaaacaaagtgaaaaatatatttgaaagggatatcatgtgccactcaaacagattaaccattcaggtcctcttttaaaactaaataagcttgtggtcaatgtttcatctttatcacgttacaacgttcgtaaaagcttgttaggacttttgttcttcttcagttttagaaaagtggttaatccaaggaccaatgtgactttgatgtactgacctggaaagttaaagatggaatcactcaattactattctttttgtaaatttctaaacaccataaagcatttaatgaactggaattgataggtgaactgtgtcattttaataagcataatgtaatcacgtcatattttgttttgtttgcaggcagaaatttagataaggatatccttaaacagctgtttatagctactgtgacagaaacagaaaagcagtggacaacacatttcaaagaagatcaagtttgtacataacactagaggcatttcttatcaaaaggattggataataaaaataagtttctactgggtatatttcaagcatttatttattactttagttacgaattccaatatactttaaaatggtatttgttttacagcatacataaaatgtagcaaatcggtactgtaaaacatttaacattcatacagttatatataatatccttttttttaaagaatggtatttcacaaaaatgtcttttgaaattggctttggagtttacatatactgaacatgaaagtttataataatgatgatacaactttcaacattgtcattttttcttagaacttcagctgattgcagagatataatgattacattgttattaaatttttttaacacaagtaagtgtcaccattttatgacatgaaataaaaggttatgactgttattgatgttgatgttgacgacctgatcacctggctgaaggagtgtttgtcaggtttctccattgtaaagttactcttttcccccatttcatactgtgctctttggaaggaaatcactatgcacagcccacactaaaggaatggggagttgtagtgtacttttttgggagtggtctacataattaattgaaattcttctgcaaagg

SEQ ID NO: 298320 - DNA, 653 bp, Homo sapiens
  misc_feature (441)..(441): n is a, c, g, or t
  misc_feature (499)..(499): n is a, c, g, or t
  misc_feature (508)..(508): n is a, c, g, or t
  misc_feature (532)..(532): n is a, c, g, or t
  misc_feature (561)..(561): n is a, c, g, or t
ccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaaggaagtgcgctggagaaatccttagctgtcagccaaggtggagagctctatgaagagtggctggaacttagaaacggttgcctctgctgttcagtgaactaanacccagtggacttacagctccttgacatttgctgtcgagtagtactcccgtaagttancctctttcnaataatatgtacttcacaagacgncttgcactcatgtactagtcccacaaaantgctaaattcagatgcaattcccggactgctaaaccaaaccactttcaccgtcacactaacgggggtatactacgggcaatgctctgaactc

SEQ ID NO: 298321 - DNA, 443 bp, Homo sapiens
ccgggcaggccgggagtggcgtgctgggcgtgcgcggctgcggtacggcgtgttggtcccagcggttcagctgaggtagggacgtgctgtaggccggaatgttaccggctgttggatctgcggatgaggaggaggatcctgcggaggaggattgtcctgaattggttcccatggagacgacgcaaagcgaggaggaggaaaagtctggcctcggcgccaagatcccagtcacaattatcaccgggtatttaggtgctgggaagacaacacttctgaactatattttgacagagcaacatagtaaaagagtagcggtcattttaaatgaatttggggaagaacatcgctggacaaatcctgagccgtcttacatggatgcgtgctttattatgagcgggtcgatcttagggacagttgcctctgatgtgcattgaatggcttat

SEQ ID NO: 298322 - DNA, 1116 bp, Homo sapiens
agtagtagagaggcccacactggctaggcaggcagcacagtcccgcggacggctgagcgtgtggctgcaggagcttctgtgggagtacggtcatgagccttttgctgtactatgccctccctgccctgggcagctatgccatgctctccatcttcttcctgcgccggcctcatctgctgcacacgcccagggctcccaccttccgcatccgcctgggggcccaccgaggaggatctggagagctgctggagaacaccatggaggccatggagaactccatggcccagcgctcggacctcctggagctcgactgtcagctgacacgggacagagtggtggtggtgtcacatgatgagaacctgtgccgccagtcgggcctaaacagggatgtgggcagcctggacttcgaggacctgcccctctacaaggagaagctggaggtttacttctctccaggccactttgctcacgggtcagaccggcgcatggttcgtctggaggacctgttccagaggtttccaaggacacccatgagcgtagagatcaaagggaagaacgaagagctcatccgtgagatagcaggcttggtgagacgctatgaccgtaatgaaatcaccatctgggcctcggagaagagctcggtcatgaagaaatgcaaggctgccaaccccgagatgcccctgtccttcacaataagccgaggattctgggtgctgctttcctactacctggggctgctgcccttcatcccaatccctgagaagttcttcttctgcttcctgcccaacatcatcaacaggacctatttcccattttcctgctcttgcctgaaccagttattggctgtggtttcgaaatggctgatcatgaggaagagtctgatccgacacttggaggagcgaggggtgcaggtggtcttttggtgccttaatgaagagtcggattttgaagcagccttcagcgtgggagccactggcgtcataacggattatcccacagccctgcggcactacctggacaaccatggaccagctgcccggacctcctaagtccagaagcctcgaggtctcctgtttctcttcctgaaaaataaatatttgcctttcgatcaaaaaa

SEQ ID NO: 298323 - DNA, 1344 bp, Homo sapiens
agtagtagagaggcccacactggctaggcaggcagcacagtcccgcggacggctgagcgtgtggctgcaggagcttctgtgggagtacggtcatgagccttttgctgtactatgccctccctgccctgggcagctatgccatgctctccatcttcttcctgcgccggcctcatctgctgcacacgcccagggctcccaccttccgcatccgcctgggggcccaccgaggaggatctggagagctgctggagaacaccatggaggccatggagaagtgagtgtatctgcccctgcccaggctgccatgtgagggtgtgcaggtcgtggactgcatcacagcaagggacgccattcacttcctagctgggtgactggcgccccctggaggtggcctgcacatcccgccacgaactccgctctcacattcccggccacctcccagccaccatgcccctcatcccagtcccctgcccctgccccccgctgaccttcacccccacagctccatggcccagcgctcggacctcctggagctcgactgtcagctgacacgggacagagtggtggtggtgtcacatgatgagaacctgtgccgccagtcgggcctaaacagggatgtgggcagcctggacttcgaggacctgcccctctacaaggagaagctggaggtttacttctctccaggccactttgctcacgggtcagaccggcgcatggttcgtctggaggacctgttccagaggtttccaaggacacccatgagcgtagagatcaaagggaagaacgaagagctcatccgtgagatagcaggcttggtgagacgctatgaccgtaatgaaatcaccatctgggcctcggagaagagctcggtcatgaagaaatgcaaggctgccaaccccgagatgcccctgtccttcacaataagccgaggattctgggtgctgctttcctactacctggggctgctgcccttcatcccaatccctgagaagttcttcttctgcttcctgcccaacatcatcaacaggacctatttcccattttcctgctcttgcctgaaccagttattggctgtggtttcgaaatggctgatcatgaggaagagtctgatccgacacttggaggagcgaggggtgcaggtggtcttttggtgccttaatgaagagtcggattttgaagcagccttcagcgtgggagccactggcgtcataacggattatcccacagccctgcggcactacctggacaaccatggaccagctgcccggacctcctaagtccagaagcctcgaggtctcctgtttctcttcctgaaaaataaatatttgcctttcgatcaaaaaa

SEQ ID NO: 298324 - DNA, 606 bp, Homo sapiens
agtagtagagaggcccacactggctaggcaggcagcacagtcccgcggacggctgagcgtgtggctgcaggagcttctgtgggagtacggtcatgagccttttgctgtactatgccctccctgccctgggcagctatgccatgctctccatcttcttcctgcgccggcctcatctgctgcacacgcccagggctcccaccttccgcatccgcctgggggcccaccgaggaggatctggagagctgctggagaacaccatggaggccatggagaactccatggcccagcgctcggacctcctggagctcgactgtcagctgacacgggacagagtggtggtggtgtcacatgatgagaacctgtgccgccagtcgggcctaaacagggatgtgggcagcctggacttcgaggacctgcccctctacaaggagaagctggaggtttacttctctccaggccactttgctcacggatcagtccgttcgcatgttaacatgcgaacggactgatcccaacaccttttcaaggaacctctcatgttcgtcacaaatactggattactacctggggacactgcagaactcacgatcagtccgttcgctggga

SEQ ID NO: 298325 - DNA, 504 bp, Homo sapiens
attccagaactgccagagactgggacgctggggaaggtaagggcgcagcagcaccagcgggagattgaactggggccacctgaggtcccgaggccccgtggggagggcgggtggggaggagaagggttctggctgccccaatccctgagaagttcttcttctgcttcctgcccaacatcatcaacaggacctatttcccattttcctgctcttgcctgaaccagttattggctgtggtttcgaaatggctgatcatgaggaagagtctgatccgacacttggaggagcgaggggtgcaggtggtcttttggtgccttaatgaagagtcggattttgaagcagccttcagcgtgggagccactggcgtcataacggattatcccacagccctgcggcactacctggacaaccatggaccagctgcccggacctcctaagtccagaagcctcgaggtctcctgtttctcttcctgaaaaataaatatttgcctttcgatcaaaaaa

SEQ ID NO: 298326 - DNA, 499 bp, Homo sapiens
ggcactaccagcccaccccacctctgggacaggggagaccctaggagctaacccccacttccttctctctgcaggacctatttcccattttcctgctcttgcctgaaccagttattggctgtggtttcgaaatggtgaggtgggcaagatggctgggtggcgtgtccccatagagacctactgctgcccttctcccaggtcccctctcatcatcacctcccacgtccccaccccacccccaggctgatcatgaggaagagtctgatccgacacttggaggagcgaggggtgcaggtggtcttttggtgccttaatgaagagtcggattttgaagcagccttcagcgtgggagccactggcgtcataacggattatcccacagccctgcggcactacctggacaaccatggaccagctgcccggacctcctaagtccagaagcctcgaggtctcctgtttctcttcctgaaaaataaatatttgcctttcgatcaaaaaa

SEQ ID NO: 298327 - DNA, 1286 bp, Homo sapiens
agcgaagtggcagggcagggtgtggacgaggaagaagatgctggcgcagcctgggctggctggggaggtgaggccagagggaggatggagcccagagagggaatgtgggtgatgaggttgggccaggcccctagaccccaagccccagaggcccactccagtgccccccacaggatctggagagctgctggagaacaccatggaggccatggagaagtgagtgtatctgcccctgcccaggctgccatgtgagggtgtgcaggtcgtggactgcatcacagcaagggacgccattcacttcctagctgggtgactggcgccccctggaggtggcctgcacatcccgccacgaactccgctctcacattcccggccacctcccagccaccatgcccctcatcccagtcccctgcccctgccccccgctgaccttcacccccacagctccatggcccagcgctcggacctcctggagctcgactgtcagctgacacgggacagagtggtggtggtgtcacatgatgagaacctgtgccgccagtcgggcctaaacagggatgtgggcagcctggacttcgaggacctgcccctctacaaggagaagctggaggtttacttctctccaggccactttgctcacgggtcagaccggcgcatggttcgtctggaggacctgttccagaggtttccaaggacacccatgagcgtagagatcaaagggaagaacgaagagctcatccgtgagatagcaggcttggtgagacgctatgaccgtaatgaaatcaccatctgggcctcggagaagagctcggtcatgaagaaatgcaaggctgccaaccccgagatgcccctgtccttcacaataagccgaggattctgggtgctgctttcctactacctggggctgctgcccttcatcccaatccctgagaagttcttcttctgcttcctgcccaacatcatcaacaggacctatttcccattttcctgctcttgcctgaaccagttattggctgtggtttcgaaatggctgatcatgaggaagagtctgatccgacacttggaggagcgaggggtgcaggtggtcttttggtgccttaatgaagagtcggattttgaagcagccttcagcgtgggagccactggcgtcataacggattatcccacagccctgcggcactacctggacaaccatggaccagctgcccggacctcctaagtccagaagcctcgaggtctcctgtttctcttcctgaaaaataaatatttgcctttcgatcaaaaaa

SEQ ID NO: 298328 - DNA, 1208 bp, Homo sapiens
agtagtagagaggcccacactggctaggcaggcagcacagtcccgcggacggctgagcgtgtggctgcaggagcttctgtgggagtacggtcatgagccttttgctgtactatgccctccctgccctgggcagctatgccatgctctccatcttcttcctgcgccggcctcatctgctgcacacgcccagggctcccaccttccgcatccgcctgggggcccaccgaggaggatctggagagctgctggagaacaccatggaggccatggagaactccatggcccagcgctcggacctcctggagctcgactgtcagctgacacgggacagagtggtggtggtgtcacatgatgagaacctgtgccgccagtcgggcctaaacagggatgtgggcagcctggacttcgaggacctgcccctctacaaggagaagctggaggtttacttctctccaggccactttgctcacgggtcagaccggcgcatggttcgtctggaggacctgttccagaggtttccaaggacacccatgagcgtagagatcaaagggaagaacgaagagctcatccgtgagatagcaggcttggtgagacgctatgaccgtaatgaaatcaccatctgggcctcggagaagagctcggtcatgaagaaatgcaaggctgccaaccccgagatgcccctgtccttcacaataagccgaggattctgggtgctgctttcctactacctggggctgctgcccttcatcccaatccctgagaagttcttcttctgcttcctgcccaacatcatcaacaggacctatttcccattttcctgctcttgcctgaaccagttattggctgtggtttcgaaatggctgatcatgaggaagagtctgatccgacacttggaggagcgaggggtgcaggtgaggccgtgaccaccacttccaccgcacacagacctggcagcagggttccggtcccactctgctgccaactagctgcatcactcgggcaggtggtcttttggtgccttaatgaagagtcggattttgaagcagccttcagcgtgggagccactggcgtcataacggattatcccacagccctgcggcactacctggacaaccatggaccagctgcccggacctcctaagtccagaagcctcgaggtctcctgtttctcttcctgaaaaataaatatttgcctttcgatcaaaaaa

SEQ ID NO: 298329 - DNA, 1224 bp, Homo sapiens
agtagtagagaggcccacactggctaggcaggcagcacagtcccgcggacggctgagcgtgtggctgcaggagcttctgtgggagtacggtcatgagccttttgctgtactatgccctccctgccctgggcagctatgccatgctctccatcttcttcctgcgccggcctcatctgctgcacacgcccagggctcccaccttccgcatccgcctgggggcccaccgaggaggatctggagagctgctggagaacaccatggaggccatggagaactccatggcccagcgctcggacctcctggagctcgactgtcagctgacacgggacagagtggtggtggtgtcacatgatgagaacctgtgccgccagtcgggcctaaacagggatgtgggcagcctggacttcgaggacctgcccctctacaaggagaagctggaggtttacttctctccaggccactttgctcacgggtcagaccggcgcatggttcgtctggaggacctgttccagaggtttccaaggacacccatgagcgtagagatcaaagggaagaacgaagagctcatccgtgagatagcaggcttggtgagacgctatgaccgtaatgaaatcaccatctgggcctcggagaagagctcggtcatgaagaaatgcaaggctgccaaccccgagatgcccctgtccttcacaataagccgaggattctgggtgctgctttcctactacctggggctgctgcccttcatcccaatccctgagaagttcttcttctgcttcctgcccaacatcatcaacaggacctatttcccattttcctgctcttgcctgaaccagttattggctgtggtttcgaaatggtgaggtgggcaagatggctgggtggcgtgtccccatagagacctactgctgcccttctcccaggtcccctctcatcatcacctcccacgtccccaccccacccccaggctgatcatgaggaagagtctgatccgacacttggaggagcgaggggtgcaggtggtcttttggtgccttaatgaagagtcggattttgaagcagccttcagcgtgggagccactggcgtcataacggattatcccacagccctgcggcactacctggacaaccatggaccagctgcccggacctcctaagtccagaagcctcgaggtctcctgtttctcttcctgaaaaataaatatttgcctttcgatcaaaaaa

SEQ ID NO: 298330 - DNA, 1064 bp, Homo sapiens
agtagtagagaggcccacactggctaggcaggcagcacagtcccgcggacggctgagcgtgtggctgcaggagcttctgtgggagtacggtcatgagccttttgctgtactatgccctccctgccctgggcagctatgccatgctctccatcttcttcctgcgccggcctcatctgctgcacacgcccagggctcccaccttccgcatccgcctgggggcccaccgaggaggatctggagagctgctggagaacaccatggaggccatggagaactccatggcccagcgctcggacctcctggagctcgactgtcagctgacacgggacagagtggtggtggtgtcacatgatgagaacctgtgccgccagtcgggcctaaacagggatgtgggcagcctggacttcgaggacctgcccctctacaaggagaagctggaggtttacttctctccaggccactttgctcacgggtcagaccggcgcatggttcgtctggaggacctgttccagaggtttccaaggacacccatgagcgtagagatcaaagggaagaacgaagagctcatccgtgagatagcaggcttggtgagacgctatgaccgtaatgaaatcaccatctgggcctcggagaagagctcggtcatgaagaaatgcaaggctgccaaccccgagatgcccctgtccttcacaataagccgaggattctgggtgctgctttcctactacctggggctgctgcccttcatcccaatccctgagaagttcttcttctgcttcctgcccaacatcatcaacaggacctatttcccattttcctgctcttgcctgaaccagttattggctgtggtttcgaaatggtggtcttttggtgccttaatgaagagtcggattttgaagcagccttcagcgtgggagccactggcgtcataacggattatcccacagccctgcggcactacctggacaaccatggaccagctgcccggacctcctaagtccagaagcctcgaggtctcctgtttctcttcctgaaaaataaatatttgcctttcgatcaaaaaa

SEQ ID NO: 298331 - DNA, 702 bp, Homo sapiens
acacaggaatagttaggtctgtcatttgagggagcccaggggacctggaacgggtcacacgggcagtgctcagttctggtgcctcttcatatgcagggccaggtggtcagagcgcgagaagctgcggttgcacaccccgcactggaagggcttggcgcctgtgtgcttccggtagtggcgggtcagctcatccgatcgcgcgaacctccagtcgcagccttcagataaaatgattttatctgaaggctgccaaccccgagatgcccctgtccttcacaataagccgaggattctgggtgctgctttcctactacctggggctgctgcccttcatcccaatccctgagaagttcttcttctgcttcctgcccaacatcatcaacaggacctatttcccattttcctgctcttgcctgaaccagttattggctgtggtttcgaaatggctgatcatgaggaagagtctgatccgacacttggaggagcgaggggtgcaggtggtcttttggtgccttaatgaagagtcggattttgaagcagccttcagcgtgggagccactggcgtcataacggattatcccacagccctgcggcactacctggacaaccatggaccagctgcccggacctcctaagtccagaagcctcgaggtctcctgtttctcttcctgaaaaataaatatttgcctttcgatcaaaaaa

SEQ ID NO: 298332 - DNA, 268 bp, Homo sapiens
gagaatggccagaacccaggaggtggagcttgcagtgagccgagatcgcaccactgcactccagcctgggcgacagagcgagactccatttcaaataaataagtaaaaataaaaataaaaaaaagtaactcttacttgaatttattaagaatacacagatgatgttgccaaagtggcaatcaaattgctttgtcattttttactttttatgtatgtttgtatgtatgtatatatttgagagagagtcttgttctgtcactcaggctgg

SEQ ID NO: 298333 - DNA, 824 bp, Homo sapiens
cttgctgtttggaaacttgtgaagacctgcatccctttgtatctcaaataaagacagaggtgtttccagacctaagaataacaggaacatggaggagtggcatctccagtgtagccacccaccaaagcctcatcctgaacactatggcctagtgggtcacttacagggatgtagctggcattgatgtagtcagagcaaggatcatcatctacattggagagcttcactcgcgtggcatcatctggaaggagagatttgctgctgagtcttggagtgacttttctacagtttatgtgatgtgtgtgatgtgccttagctctgatccccacaacagccacagatgggaagtgatcttatctccattttgcagatgaggctcaggcaggataactaacttgccccatgttgcataggtggcctataaccagtcagacacaggagacaacatgaagccccatctgtgcttccctttctgacattaccacatttgcctgatggagtggccagctccctttcactgctggaatgaatacaatccagaaaacctaccttctattgctttacctaatggggtaaggaaatttaagtagaaattgctaaccgaagactttgctaagcaaacccaggtctgcttgatgtcagagcccttgctgttaaccccatttactgcttagcctccaaagagaagcaatagcatcacatggggaaatgtcaacagcataagaggactttcataatcagaatttaaactggctattatccctctggagggaagtgcaggaatatacaagctatttcttattaaaggcattcagagcttgaga

SEQ ID NO: 298334 - DNA, 654 bp, Homo sapiens
gaaggcccttgccctaacctcattcttacactttctttttttgtttctcagtttctccttagactctcagtctcttttccttctttctcttgctcttttgttcttcctgatttgtctctcaacctctagtttcactagtcatgctctcgagtgtcgtgttttcctcagtgtcttctgcccatcgtgcgtttctttctccaccttattctgtgtttctgtttcagttgctctgcttctctccctctctttctgttgctgtttctctgtgtctctgtcactgttggtctttccctgttactttgggaatctctctgtctgtctttctgtatctatgcctctgtttctcattccatctccactcccgggagtggagagagaatgcagaaccactgaaatgtgccagtgagcgatgggatgggtgttgtctgagctgttctctgagcggctcgggcacttccagtcttcgttcacctcccttgatcacgtctctaccgatgacgatccagcacatgtgacttgaggatcccgcgcacaagctcacactatatccccaccagctgtgtgtcacattcgtcagacccagggagtcctttacttacaccgccttctccagtccccttcattctctcgcactcccgggtatactctaggaga

SEQ ID NO: 298335 - DNA, 404 bp, Homo sapiens
ctgtagcgcccatgaccgcagggtgcctgcagaagcacttgcccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctacattcatccccatccccaactgcgaccagcctgagcaatatagccagacccccgtctctacaaaaaaaaaaaaaaaaaaaataggcaactgcagtggctcatgcctgtagtcccaggtatttgggagtctgagatgagaagttcaaggttacaatgagctatgatcacgtgattgcactccagcctgggcgactctatttcgta

SEQ ID NO: 298336 - DNA, 1323 bp, Homo sapiens
gaaggcccttgccctaacctcattcttacactttctttttttgtttctcagtttctccttagactctcagtctcttttccttctttctcttgctcttttgttcttcctgatttgtctctcaacctctagtttcactagtcatgctctcgagtgtcgtgttttcctcagtgtcttctgcccatcgtgcgtttctttctccaccttattctgtgtttctgtttcagttgctctgcttctctccctctctttctgttgctgtttctctgtgtctctgtcactgttggtctttccctgttactttgggaatctctctgtctgtctttctgtatctatgcctctgtttctcattccatctccgaccctgttttgctctcctgtgcctctgtctgtctctgtctcttttcctggtgcttgaagcttccattgttgcagtccggatgctgggactccagccccaagcttcctgtcctgggacccaaaccctccacttcctcaatcctctgcagcttgtcagccgaggagagcaggatgcagggaaaacaggaaggaggtggactccaggggtctgggcctcgggcctctctgcccttcctgcccctgggtagggagagatgggtcagcagaaaacattctaggagaaatgccagcctggcacccagcatatctgggaaggggggtcctgggggagaaagtcgctaatcttggggcagagatgccagtggcaatggtagaggaggggtactgagactgggagggagcaagggccgagcccttgggttcgcggggtacaacagagtcacgttccctttgaatctccatcctccaccagccagagggtatctggcaccagataaggatggctggtagcctcctcctctctcagcactttgaatgcaagacagaagagccctcaaagggctgggtaggaatacctcatcctctggttgggtaggaatactccatcctgtagtggaggaaaataagatcccctaggggtttggggagggcatggcatgagaattttgtggttgtcctctggatataatgcaaactggcctccaggaatatctaggggctgggtgtggaggttcatgcttgtaatcccagcactttgggaggattgcttgaggccaggagttcgagaccagcctgagcaatatagccagacccccgtctctacaaaaaaaaaaaaaaaaaaaataggcaactgcagtggctcatgcctgtagtcccaggtatttgggagtctgagatgagaagttcaaggttacaatgagctatgatcacgtgattgcactccagcctgggcgactctatttcgta

SEQ ID NO: 298337 - DNA, 1042 bp, Homo sapiens
tagactgggttgggcaggcctactgactgctgcctgaaggttgctgtaaagggactaagtaaatcaattaactccacagttttcacaaaggtctcttgatatcaaaacttctttccttgcatgcttctctgatcctgtggagatgaaaattgacatccatagtcatattctaccaaaagaatggccagatctaaaaaaggtaatggtaattaatttgctgaattatttctgaaacttctccagggtttctcaatgcctttctcttctttgtggaattagatgtctagtttatctgctttggtggggggcgagggggttaaatcatttggtagttctgattttctagcttttaaaaatgacttttatatttattttgaaataacattggattaaagaaataagtgctttctcagaaacccttttttccctcaaatgaaccattctttaaaatatctggacaatttaaataaggcagatttaccttttcaaaaatcacatattcagctgctgggaagatacatgccaactacagaatttaaagttacaattttaagtagaagaccattaaaaatggaatgtgatcggtttcaaggacttctaaaatatatctcctttccaaaatgtttaaaataagttttagaagcaccaagagatagctttgtgaatttttttagtctattttaggacactgcctgaaacctttactgtttgatgttctttattctataaatctttgtcctgaagaactaggaagtaggtacatcaaaaaacccgagaataaatgacatgaagcttttgcacagtgacatctcctaagagagtattctttgtgtttctctaaagatggaaatttccttttgtcattaagaacttttgaatgaatataaaaagaggaaggtgaggaacatgaaagaaatgtaaaattggctagaggtttgttcaggcttaatatcaggttttacccaatcttcagcattctgccagtactttcacaccaccgataatgtttcaacttttttatcccaagtgagggaaaatgaat

SEQ ID NO: 298338 - DNA, 1710 bp, Homo sapiens
tagactgggttgggcaggcctactgactgctgcctgaaggttgctgtaaagggactaagtaaatcaattaactccacagttttcacaaaggtctcttgatatcaaaacttctttccttgcatgcttctctgatcctgtggagatgaaaattgacatccatagtcatattctaccaaaagaatggccagatctaaaaaagaggtttggctacggaggctgggtgcagctccaacaccacagcaagggagaagcaaagttgttgaaagatgggaaagtcttcagagtggtgcgagagaattgctgggatccagaagttcgtattagagaaatggaccaaaaaggagtaacagtgcaagccctttccacagttcctgtcatgtttagctactgggccaaacctgaggacactttaaacctgtgccagcttttaaacaacgaccttgccagcaccgttgtgagctaccccaggaggttcgtgggtctggggacgttgcccatgcaggcccctgagctggcggtcaaggagatggagcgctgtgtgaaagagctgggctttcccggggtccaaattggcacccacgtcaacgagtgggacctgaacgcgcaggagctctttcctgtctatgcggcagccgaaaggctgaagtgttccctgttcgtgcatccctgggacatgcagatggatggacgaatggccaaatactggctcccttggcttgtaggaatgccagcagagaccaccatagccatttgctccatgatcatgggtggagtatttgagaagtttcccaaactgaaagtgtgtttcgcacatggtggtggtgccttccccttcacagtgggaagaatctcccatggattcagcatgcgcccagatctgtgtgcccaggacaaccccatgaacccgaagaaataccttggttccttttacacagatgctttggttcatgatcctctgtccctcaagctgttaacagatgtcataggaaaggataaagtcattttgggaaccgattacccctttccactaggtgagctggaacctgggaaactaatagagtccatggaagaatttgatgaagaaacaaagaataaactcaaagccggcaatgccctggcatttttgggtcttgagagaaaacaatttgaatgactgaatttactacaaaggcaaactttcaaaaggatatctcatttttgtttctaaatatgtatcaacaggtatcaacaaaatcctattttgaactattttactcagaaatgaatgtcccaaatatcctaaattattcataataaaaatgatttgtaagtgttttcattctgaaaaaaaaaaaaaaaaaaaaaaaaaagagatataaaaaaaaaaataacacaaaacagaaaaaaaaaaaaaaaaaagagggggggcgccagcaaagatatacacagagcggggacacaagtaacgacaccagcatgtaagaagaaaggccccccaaagagccattaaagaagaacgagcagggcgcggaacaacacagcagaggtagaaaaacatgaaaaaatagatgataaatgagaaagcaacaaacaatacgacgagagagcaaaatgagggcatatacaagaagaaattacacagcagaggtagaactaatagttcgtgatgattagttatacaacatcatatattgtgggacatagtgtgctcagatgaaatgaaaaaaatcg

SEQ ID NO: 298339 - DNA, 1770 bp, Homo sapiens
tagactgggttgggcaggcctactgactgctgcctgaaggttgctgtaaagggactaagtaaatcaattaactccacagttttcacaaaggtctcttgatatcaaaacttctttccttgcatgcttctctgatcctgtggagatgaaaattgacatccatagtcatattctaccaaaagaatggccagatctaaaaaagcagaccctgagacaaggattcagatgcaagtagtttgctttggaggtgatcccaggaaacaccagtagagtgaggaagtgagacagggaaaacagggcagccagtgaaagaggtttggctacggaggctgggtgcagctccaacaccacagcaagggagaagcaaagttgttgaaagatgggaaagtcttcagagtggtgcgagagaattgctgggatccagaagttcgtattagagaaatggaccaaaaaggccaaacctgaggacactttaaacctgtgccagcttttaaacaacgaccttgccagcaccgttgtgagctaccccaggaggttcgtgggtctggggacgttgcccatgcaggcccctgagctggcggtcaaggagatggagcgctgtgtgaaagagctgggctttcccggggtccaaattggcacccacgtcaacgagtgggacctgaacgcgcaggagctctttcctgtctatgcggcagccgaaaggctgaagtgttccctgttcgtgcatccctgggacatgcagatggatggacgaatggccaaatactggctcccttggcttgtaggaatgccagcagagaccaccatagccatttgctccatgatcatgggtggagtatttgagaagtttcccaaactgaaagtgtgtttcgcacatggtggtggtgccttccccttcacagtgggaagaatctcccatggattcagcatgcgcccagatctgtgtgcccaggacaaccccatgaacccgaagaaataccttggttccttttacacagatgctttggttcatgatcctctgtccctcaagctgttaacagatgtcataggaaaggataaagtcattttgggaaccgattacccctttccactaggtgagctggaacctgggaaactaatagagtccatggaagaatttgatgaagaaacaaagaataaactcaaagccggcaatgccctggcatttttgggtcttgagagaaaacaatttgaatgactgaatttactacaaaggcaaactttcaaaaggatatctcatttttgtttctaaatatgtatcaacaggtatcaacaaaatcctattttgaactattttactcagaaatgaatgtcccaaatatcctaaattattcataataaaaatgatttgtaagtgttttcattctgaaaaaaaaaaaaaaaaaaaaaaaaaagagatataaaaaaaaaaataacacaaaacagaaaaaaaaaaaaaaaaaagagggggggcgccagcaaagatatacacagagcggggacacaagtaacgacaccagcatgtaagaagaaaggccccccaaagagccattaaagaagaacgagcagggcgcggaacaacacagcagaggtagaaaaacatgaaaaaatagatgataaatgagaaagcaacaaacaatacgacgagagagcaaaatgagggcatatacaagaagaaattacacagcagaggtagaactaatagttcgtgatgattagttatacaacatcatatattgtgggacatagtgtgctcagatgaaatgaaaaaaatcg

SEQ ID NO: 298340 - DNA, 1368 bp, Homo sapiens
tagactgggttgggcaggcctactgactgctgcctgaaggttgctgtaaagggactaagtaaatcaattaactccacagttttcacaaaggtctcttgatatcaaaacttctttccttgcatgcttctctgatcctgtggagatgaaaattgacatccatagtcatattctaccaaaagaatggccagatctaaaaaagaggtttggctacggaggctgggtgcagctccaacaccacagcaagggagaagcaaagttgttgaaagatgggaaagtcttcagagtggtgcgagagaattgctgggatccagaagttcgtattagagaaatggaccaaaaaggagtaacagtgcaagccctttccacagttcctgtcatgtttagctactgggccaaacctgaggacactttaaacctgtgccagcttttaaacaacgaccttgccagcaccgttgtgagctaccccaggaggttcgtgggtctggggacgttgcccatgcaggcccctgagctggcggtcaaggagatggagcgctgtgtgaaagagctgggctttcccggggtccaaattggcacccacgtcaacgagtgggacctgaacgcgcaggagctctttcctgtctatgcggcagccgaaaggctgaagtgttccctgttcgtgcatccctgggacatgcagatggatggacgaatggccaaatactggctcccttggcttgtaggaatgccagcagagaccaccatagccatttgctccatgatcatgggtggagtatttgagaagtttcccaaactgaaagtgtgtttcgcacatggtggtggtgccttccccttcacagtgggaagaatctcccatggattcagcatgcgcccagatctgtgtgcccaggacaaccccatgaacccgaagaaataccttggttccttttacacagatgctttggttcatgatcctctgtccctcaagctgttaacagatgtcataggaaaggataaagtcattttgggaaccgattacccctttccactaggtgagctggaacctgggaaactaatagagtccatggaagaatttgatgaagaaacaaagaataaactcaaagccggcaatgccctggcatttttgggtcttgagagaaaacaatttgaatgactgaatttactacaaaggcaaactttcaaaaggatatctcatttttgtttctaaatatgtatcaacaggtatcaacaaaatcctattttgaactattttactcagaaatgaatgtcccaaatatcctaaattattcataataaaaatgatttgtaagtgttttcattctgaaaagcagtacattatttcatgtgcaaataaaaaatgattttccc

SEQ ID NO: 298341 - DNA, 1017 bp, Homo sapiens
tagactgggttgggcaggcctactgactgctgcctgaaggttgctgtaaagggactaagtaaatcaattaactccacagttttcacaaaggtctcttgatatcaaaacttctttccttgcatgcttctctgatcctgtggagatgaaaattgacatccatagtcatattctaccaaaagaatggccagatctaaaaaagcagaccctgagacaaggattcagatgcaagtagtttgctttggaggtgatcccaggaaacaccagtagagtgaggaagtgagacagggaaaacagggcagccagtgaaagaggtttggctacggaggctgggtgcagctccaacaccacagcaagggagaagcaaagttgttgaaagatgggaaagtcttcagagtggtgcgagagaattgctgggatccagaagttcgtattagagaaatggaccaaaaaggccaaacctgaggacactttaaacctgtgccagcttttaaacaacgaccttgccagcaccgttgtgagctaccccaggaggttcgtgggtctggggacgttgcccatgcaggcccctgagctggcggtcaaggagatggagcgctgtgtgaaagagctgggctttcccggggtccaaattggcacccacgtcaacgagtgggacctgaacgcgcaggagctctttcctgtctatgcggcagccgaaaggctgaagtgttccctgttcgtgcatccctgggacatgcagatggatggacgaatggccaaatactggctcccttggcttgtaggtttgtgtctgtgtggggtctggaacagaggaccaactcttgggtttttccaatcatctatggaaacctattatgtcaaatagggaaagtatgaataattaacaggattatgagtaatagcagctatcacttactgagctcttacttggattaatgctatatatatatatataacctcatttaattttaaacatatccaataccatcataaataaatcatatatttaatctatga

SEQ ID NO: 298342 - DNA, 1054 bp, Homo sapiens
tagactgggttgggcaggcctactgactgctgcctgaaggttgctgtaaagggactaagtaaatcaattaactccacagttttcacaaaggtctcttgatatcaaaacttctttccttgcatgcttctctgatcctgtggagatgaaaattgacatccatagtcatattctaccaaaagaatggccagatctaaaaaagcagaccctgagacaaggattcagatgcaagtagtttgctttggaggtgatcccaggaaacaccagtagagtgaggaagtgagacagggaaaacagggcagccagtgaaagaggtttggctacggaggctgggtgcagctccaacaccacagcaagggagaagcaaagttgttgaaagatgggaaagtcttcagagtggtgcgagagaattgctgggatccagaagttcgtattagagaaatggaccaaaaaggtacgatgagaagtgctaccaatgttagcatctgatgtaaaagcaatgtctgcccttaaagtttgctgacaactttatgtgatggtaacttctgacccccttttctctgccaggacaggctgttccagcttcactgtgggagggacagggccttccactacaatgcttttagagtgtggattcaaaatgtttcatatgagttataccctgttttaaaatagaatgctatatcatgaaaaagataaaaatggcattttattatttttaaaaattagttcaaatgtatagtatttacttattataaaatcaattaaaatagtaaaaactggaaatcacaaaactaagaatgacaattgcctgcttaataacacttaagatccaatttctttctgtagtttgtctcggtgcatcatacacagaacattcccactgacacatcagggttggaaatggaagcagttaaaaatagttaattgtgtaatctcagaatacactacaataaaatcaatccagaaatttgaaagaagagaattaggaagtgttcgtttcaaagctgaattgctaaaaagctataagaacatcttgcactttttaccttatatc

SEQ ID NO: 298343 - DNA, 546 bp, Homo sapiens
taatgggatggctgggtcaaatggtatttctagttctagatccctgaggaatcgccacactgacttccacaatggttgaactagtttacactcccaccaacagtgtaaaagtgttcctatttctccacatcctctccagcacctgttgtttcctgactttttaatgatagccattctaactggtgtgagatggtatctcattgtggttttgatttgcatttctctgatggccagtgatggtgagcattttttcatgtgtcttttggctgcataaatatcttcttttgagaagtgtctgttcctatcgtttgcccactttttgatggggttgtttgtttttttcttgtaaatttgtttgagttctttgtagattctggatattagccctttgtcagatgagtaggatgtgaaaattttctcccattttgtaggttgcctgttcactctgatggtagtttcttttgctgtgcagaagctcttgagtttaattagatcccattggtcaattttggcttttgttgccattgcttttggtgttttagacat

SEQ ID NO: 298344 - DNA, 192 bp, Homo sapiens
ttaacttgggtgttttctacattaccaggaactggtcagcgttctaatttggtgttccatgttcggggtttgtgtctggtggaccctgatacatcagcaaatctggtgatttacttcctttagaatgttgtgaaattacagaagagtgagatggtagccctgctgatctcaaagcttctgatactgaaatta

SEQ ID NO: 298345 - DNA, 604 bp, Homo sapiens
gacactacctgctgctgttgttttgatttctgaccaaaagacatgttaatatgttaaagcagtgactttatggcagtctagcagttgtaccgcaaagcaagaaaaaagaagatagaaatcatgacaagcctgaataaaaatggaaaaattacagaacagtatatagatattttgataccactcagggcctttagtgctcacacatctggattgtttaccttatttttttcagttttcagcaggatgtttggcattatggaggtcaaggaacaagtatttttttaaaaatgagcatcatcggctgggcgcagtggctcatgcctgtgatcccagcactttgggaggctgaggcgggtggatcatgaggtcaggagtttgcgaccagcctggccaccatggtgaaaccctgtctctattaaaaatacaaaaattagctggacgtggtggcgggcgcctgttaaattccccccaaaaagcctttaaaacctttcccggggggggaaaagccttgaggcaggagaatcgcttgaaactgcgacagggggccaaggaagaattgcagtgagctgcagaattccatgccattgtactccagcctgggcaa

SEQ ID NO: 298346 - DNA, 355 bp, Homo sapiens
gcctaagcgttactcagaagcttagaaaagagaggccatgtctttgtcagcttgggctgccataacaagactggcgacttaaacgacatttattttctcacagccctggaggccagaagtttgagatcaggatgacagcatggttggtttctggtgagatcctgctttctggcatgcagatggccttcttcttgctgtatgctcacgtggcctttcctggcatgtgcatacagagagaggcaatctcactctcttcctcttcttataaggcccctgtattatctggttaggaccccacccttatgagctcatgtaaccttaattacctcctaaaagtcttgtgtccaaatatagt

SEQ ID NO: 298347 - DNA, 281 bp, Homo sapiens
aatcccaactactcgggaagctgaggcaggagaatcgcttgaaactggaaggcagagattgcagtgagctgagatcatgccattgtactccagcctgggcaacaagagcgaaactccatctaaaaaacaaaaaaagaaagaaaaaagaaaggagaaaaaaaaaaaaagagcatcaccagaaaggcctaagcgttactcagaagcttagaaaagagaggccatgtctttgtcagcttgggctgccataacaagactggcgacttaaacgacatttattttct

SEQ ID NO: 298348 - DNA, 465 bp, Homo sapiens
aaaattgtacatttgtacccaaattgccttaagttatggacttaaaataataattacaatataagtccagataattgagcatttactgcagatgtatacagacatacatgtatatacatatataaattgcatatatagagatatttagtattttactgttgaaagaattcttatagagtacctttttattcctctttttattaagaactctcggctttagagtcagacagggatgggctcaaattcctgctgtgctactgtataacctggacaaactgcttcaccttttttatcttcagttttcacagctatagaagtaatacaaaccattaagtgtttttataggacacggtgagatgatgaatgtaagtgtatattatttaacggaaactgaaaaaatcggttactaaaaataatatacatagagctcctataaataaatagaaatatagaaaacacacgctg

SEQ ID NO: 298349 - DNA, 1420 bp, Homo sapiens
gcggccgcggcggcagcggctgcggggagctccagcagcggcggcggcggcggcggcggcagcggcagcggcagcagcagcagcgacacgtccagcaccggcgaggaggaaaggatgcggcgcctcttccagacgtgcgacggcgacggggacggatacatcagcaggtacgcggggaggtacgaggaaaccgacaggagcgagatcagtccctccgcgcgcccttgacccctgctctgccccctcgccccaacttgcggcaagttgctcagaagctcgcgggaaaagttggccgcgactccgagagcgcgtagccggctcggccacgaaggccgaggggactgctctgttcgccttgcgggggtgccagttggtccaacttttcccagcgctgtctttgtctaggcgttgggagacatctccttaggatgcgcactcttccgggggctcggagtgttcttccctgtgggaaaaggagttctggccgcttgtcccaggtaggaggggctgccccacagcctcggggtcctgggcatcaagatgccgcagcacggggcagcgatctgcccggcggcttggtggacaccccagggccgcaccgggaggagatgagctaagcgacagcctcggacagggaaataacctgtgaagaaactttcttgtgccgcagaacccatgaattccaaacttcagagcccaaagaatgggtatcgtttgccacccagtattgatttaaacgcagtagcctgagaggaacgaagcgctcaggagcaaactagggctagacccgactcctacccggctctgtgcgctgaccaggtgagcttcggcgtggctccgggcgcctccgctccactcacaaacaaactttggggtgtttgcttcggatcccccgcacttcctacagaggcggtatttaagcttcctgcgtcccggcttggccaaataattacttctgcccaaatttgtgtcacttagactcttgtggtgaagaaggcaatcgcaacattttctggtatgcttctattgaatggttgacaccggccattgaagacttggtatccgtggaaatttgaattgccttggatgaaggagcagcctaagttgtgcattacatgtttctttagtctatgtcttggtgatgctaaagatcgtttctgaaaatccggggctgcttcctaattgtccctgcctacctaaaaaaaaaaaaaagaaaacaaagtgcggaatttttcccttaaaataaaaaaaattatttatttgggactcaacgcaattttgatcattcttaagtgaatttttattactttcctaaagttttactgagaaacattaggaagatatcagaaaacttgatggagtaattctgttcggaaatgaaaataatatgtaattctgattgactccatgcaaatttcta

SEQ ID NO: 298350 - DNA, 1182 bp, Homo sapiens
gcggccgcggcggcagcggctgcggggagctccagcagcggcggcggcggcggcggcggcagcggcagcggcagcagcagcagcgacacgtccagcaccggcgaggaggaaaggatgcggcgcctcttccagacgtgcgacggcgacggggacggatacatcagcaggcgttgggagacatctccttaggatgcgcactcttccgggggctcggagtgttcttccctgtgggaaaaggagttctggccgcttgtcccaggtaggaggggctgccccacagcctcggggtcctgggcatcaagatgccgcagcacggggcagcgatctgcccggcggcttggtggacaccccagggccgcaccgggaggagatgagctaagcgacagcctcggacagggaaataacctgtgaagaaactttcttgtgccgcagaacccatgaattccaaacttcagagcccaaagaatgggtatcgtttgccacccagtattgatttaaacgcagtagcctgagaggaacgaagcgctcaggagcaaactagggctagacccgactcctacccggctctgtgcgctgaccaggtgagcttcggcgtggctccgggcgcctccgctccactcacaaacaaactttggggtgtttgcttcggatcccccgcacttcctacagaggcggtatttaagcttcctgcgtcccggcttggccaaataattacttctgcccaaatttgtgtcacttagactcttgtggtgaagaaggcaatcgcaacattttctggtatgcttctattgaatggttgacaccggccattgaagacttggtatccgtggaaatttgaattgccttggatgaaggagcagcctaagttgtgcattacatgtttctttagtctatgtcttggtgatgctaaagatcgtttctgaaaatccggggctgcttcctaattgtccctgcctacctaaaaaaaaaaaaaagaaaacaaagtgcggaatttttcccttaaaataaaaaaaattatttatttgggactcaacgcaattttgatcattcttaagtgaatttttattactttcctaaagttttactgagaaacattaggaagatatcagaaaacttgatggagtaattctgttcggaaatgaaaataatatgtaattctgattgactccatgcaaatttcta

SEQ ID NO: 298351 - DNA, 1649 bp, Homo sapiens
  misc_feature (5)..(5): n is a, c, g, or t
cgganctgcgctctgtcgcccaggttggagtgcagtggtgtgatctcgggtcgctgcaacctccgcctcccgggttccagcagttctcctgcctcagcctcccgagtagctgtaatcccagctacccaggaagctgaggcagaattgcttgaacccaggagttggaggttgcaatgagaagattgtgccactgcactccagcctgggtgacagaaaaaccaaacaagcaaataaacatcaaaacaaaaacctgttaaagcaggttgtgctgtgagaagaacttttctgcctggcttctgctttatagcctataagatagactggaggcctatttaagacttttgttaaaattcatgatacgagttgagttattaatctgcccatttaaaccgggcagtgtatttttaatggttattggatgcaggagccagattactgaggaaatggtaggattccttgactggacagctttaagaacaagtagtctagtgaaaccagggcagataccacccattcccagcaatcttttttgtttgcaatttcaattcattttccaaattgtggatagttttatgaatttctttgagaaaaagttgaaattatttcataatgaagacgagtcagagagaaaaggattagcctagcatttgtcctctttatataaaggacttcttatagcctgattcctaatgcagagttcagtgaaagtgacatttatttggtaacagcttttgagaaatgttactttatttctaaataattatatacttggcagtttattcttccagttaagtttactaatagttactgatttgttaatataagtttgtaagttgtttttgaaagttaaaatgaagctgggtgtggtggctcacacctgtaatcccagcgctttgggaggccaaggcgggcagatcaaggagtcaggagatggagaccagcctggccaacatagggaaaccctatctctactaaaaacacaaaaattagctgggtgtgatggcgtgcacctgtaagctgagctactcaggaggctaaggcaggagaatcgcttgaatccgggaggcggaggttgcagtgagctgagatcaggtgccactgtactccagcctgagctacagagcaagactccatctcaaaaaaaaaaaaatagttaaaatcatagtgacaactttgtagctaggagttagagacagctaagaggactgtttttagcttagatgtttccatgaagaaatttgtgcagactgagatttcctctgagataaaaagaaagaagggcagacaacaaaggaggttaggtatttgtgacacctttgataataaaaagcaaagcttcttttaaaataaatctgatgttggccgggcgcggtggctcacacctgtaatcccagcactttgggaggctgaggcgggcagatcactagaggtcaggagtttgagaccagcctggccaacatgggaaaaccccatctctattaaaaatacaaaaattagccaggcaaggtggtgcatgcctgtaatcccagctgctcaggaggctgaggcaggagaatcacttgaacccaggaggtggaggttgcagtgagcctagatcgcaccattacactccagcctgggtgacagaatgagactcctccttcttaaaa

SEQ ID NO: 298352 - DNA, 842 bp, Homo sapiens
tagaatatgtttgagtctttgcagataaagaccacattgacttcagaatgcagcatataggcatgctgcatttaaaagaagggaaattattatttcaatttaatatgagcagtcgctatcttctttttaagggatttgttctaatagcagttacggtttaagaagataatggaagtgttgctttaacttcataggggtctgtaagagtattctcccatactcaaggggaaggaagcagaactgttgttctttctataggcggaggttgcagtgagctgagatcaggtgccactgtactccagcctgagctacagagcaagactccatctcaaaaaaaaaaaaatagttaaaatcatagtgacaactttgtagctaggagttagagacagctaagaggactgtttttagcttagatgtttccatgaagaaatttgtgcagactgagatttcctctgagataaaaagaaagaagggcagacaacaaaggaggttaggtatttgtgacacctttgataataaaaagcaaagcttcttttaaaataaatctgatgttggccgggcgcggtggctcacacctgtaatcccagcactttgggaggctgaggcgggcagatcactagaggtcaggagtttgagaccagcctggccaacatgggaaaaccccatctctattaaaaatacaaaaattagccaggcaaggtggtgcatgcctgtaatcccagctgctcaggaggctgaggcaggagaatcacttgaacccaggaggtggaggttgcagtgagcctagatcgcaccattacactccagcctgggtgacagaatgagactcctccttcttaaaa

SEQ ID NO: 298353 - DNA, 2002 bp, Homo sapiens
tactggctatatagaagtgcattttgtgaagcactatgggtgatatgttttgccacattgtgtacatgtatataataacccttttcctgattaaaagaatagtacatggttattgtggttattcacagtgtgtaaaatacaactctattttaacacagaaagacaattcttaaccagcttgtattggttacactataacactttcttagtgttttagttagttccctccttttaatttttggccatttccttcaaccaacagcagggtcatcttgataataaagaatagtttaaacaagcaggccgggtgcagtggctcatgcctgtaatcccagcactttgcgaggctgaggcgggtggatcacttgaggtcaggagttcgaggccagcctggccaatgtggtgaaaccccgtctctactaaaataaaatacaaaagttagccaggtgcgatggcgggtgcctgtaatcccagctacccaggaagctgaggcagaattgcttgaacccaggagttggaggttgcaatgagaagattgtgccactgcactccagcctgggtgacagaaaaaccaaacaagcaaataaacatcaaaacaaaaacctgttaaagcaggttgtgctgtgagaagaacttttctgcctggcttctgctttatagcctataagatagactggaggcctatttaagacttttgttaaaattcatgatacgagttgagttattaatctgcccatttaaaccgggcagtgtatttttaatggttattggatgcaggagccagattactgaggaaatggtaggattccttgactggacagctttaagaacaagtagtctagtgaaaccagggcagataccacccattcccagcaatcttttttgtttgcaatttcaattcattttccaaattgtggatagttttatgaatttctttgagaaaaagttgaaattatttcataatgaagacgagtcagagagaaaaggattagcctagcatttgtcctctttatataaaggacttcttatagcctgattcctaatgcagagttcagtgaaagtgacatttatttggtaacagcttttgagaaatgttactttatttctaaataattatatacttggcagtttattcttccagttaagtttactaatagttactgatttgttaatataagtttgtaagttgtttttgaaagttaaaatgaagctgggtgtggtggctcacacctgtaatcccagcgctttgggaggccaaggcgggcagatcaaggagtcaggagatggagaccagcctggccaacatagggaaaccctatctctactaaaaacacaaaaattagctgggtgtgatggcgtgcacctgtaagctgagctactcaggaggctaaggcaggagaatcgcttgaatccgggaggcggaggttgcagtgagctgagatcaggtgccactgtactccagcctgagctacagagcaagactccatctcaaaaaaaaaaaaatagttaaaatcatagtgacaactttgtagctaggagttagagacagctaagaggactgtttttagcttagatgtttccatgaagaaatttgtgcagactgagatttcctctgagataaaaagaaagaagggcagacaacaaaggaggttaggtatttgtgacacctttgataataaaaagcaaagcttcttttaaaataaatctgatgttggccgggcgcggtggctcacacctgtaatcccagcactttgggaggctgaggcgggcagatcactagaggtcaggagtttgagaccagcctggccaacatgggaaaaccccatctctattaaaaatacaaaaattagccaggcaaggtggtgcatgcctgtaatcccagctgctcaggaggctgaggcaggagaatcacttgaacccaggaggtggaggttgcagtgagcctagatcgcaccattacactccagcctgggtgacagaatgagactcctccttcttaaaa

SEQ ID NO: 298354 - DNA, 1040 bp, Homo sapiens
ttcacctcatctgctgatgacatacgtggcattcagtccctgtatggagacccaaaagagaaccaacgcttgccaaatcctgacaattcagaaccagctctctgtgaccccaatttgagttttgatgctgtcactaccgtgggaaataagatctttttcttcaaagacaggttcttctggctgaaggtttctgagagaccaaagaccagtgttaatttaatttcttccttatggccaaccttgccatctggcattgaagctgcttatgaaattgaagccagaaatcaagtttttctttttaaagatgacaaatactggttaattagcaatttaagaccagagccaaattatcccaagagcatacattcttttggttttcctaactttgtgaaaaaaattgatgcagctgtttttaacccacgtttttataggacctacttctttgtagataaccagtattggaggtatgatgaaaggagacagatgatggaccctggttatcccaaactgattaccaagaacttccaaggaatcgggcctaaaattgatgcagtcttctactctaaaaacaaatactactatttcttccaaggatctaaccaatttgaatatgacttcctactccaacgtatcaccaaaacactgaaaagcaatagctggtttggttgttagaaatggtgtaattaatggtttttgttagttcacttcagcttaataagtatttattgcatatttgctatgtcctcagtgtaccactacttagagatatgtatcataaaaataaaatctgtaaaccataggtaatgattatataaaatacataatatttttcaattttgaaaactctaattgtccattcttgcttgactctactattaagtttgaaaatagttaccttcaaaggccaagagaattctatttgaagcatgctctgtaagttgcttcctaacatccttggactgagaaattatacttacttctggcataactaaaattaagtatatatattttggctcaaataaaattgaaaaaaaaatcat

SEQ ID NO: 298355 - DNA, 385 bp, Homo sapiens
agatagatcgagccggtaccctgaaatgggcacagaaattgatgcagtcttctactctaaaaacaaatactactatttcttccaaggatctaaccaatttgaatatgacttcctactccaacgtatcaccaaaacactgaaaagcaatagctggtttggttgttagaaatggtgtaattaatggtttttgttagttcacttcagcttaataagtatttattgcatatttgctatgtcctcagtgtaccactacttagagatatgtatcataaaaataatttctgtgcccatttcaactatctttggatgactttggagagaagactcctctctcctcgtctgcggcgtgaacttgatcatggactggtgcctttgcattcagaag

SEQ ID NO: 298356 - DNA, 534 bp, Homo sapiens
agatagatcgagccggtaccctgaaatgggcacagaaattgatgcagtcttctactctaaaaacaaatactactatttcttccaaggatctaaccaatttgaatatgacttcctactccaacgtatcaccaaaacactgaaaagcaatagctggtttggttgttagaaatggtgtaattaatggtttttgttagttcacttcagcttaataagtatttattgcatatttgctatgtcctcagtgtaccactacttagagatatgtatcataaaaataaaatctgtaaaccataggtaatgattatataaaatacataatatttttcaattttgaaaactctaattgtccattcttgcttgactctactattaagtttgaaaatagttaccttcaaaggccaagagaattctatttgaagcatgctctgtaagttgcttcctaacatccttggactgagaaattatacttacttctggcataactaaaattaagtatatatattttggctcaaataaaattgaaaaaaaaatcat

SEQ ID NO: 298357 - DNA, 903 bp, Homo sapiens
ggcggccgcggatataaagcgcggcggcggctgccgggcggagcggctgcacggacaagagcggaggcctgggtgagcgcggcccgacggcacgggctaggacagacggacgcagacggcccgacgacctgggcgttcggcggaggggcgctggggcctgactcgcggaaggggaaactgaagcagaaagaggttacttaatgggctcaaggtcacctacctgacctaccagcagctcaatggccttcccaaagaagaaacttcagggtcttgtggctgcaaccatcacgccaatgactgagaatggttttaagaaagactggcatcagctgtttctcaatgcatcagtcacttgttcgcagatcaaacagaagacatgtgattgcatgaatcggcaggatttacttcctgttaacagagtgagatcctttctgtaatctcctaacactgcatctggtccatactactttaaccttttaataagacccctcttatcctggaagtggcttcttaaaacagtcttgtttgttcatcagggacccacggacaatgtcagtgtgttcttcctccctgttttgccgttttcctggaaggccagatcccatgatagagataactaaaatgactttttctggatctttttccgtttcccaaaaatctgtggtcctgctgcatccattttactattttctcatcaattctgcgtttttcttctaggaaccttactttcctaaggtgtgaaatcaaaaaaaaaaaaaaaaaaaagaatgcattatgtgtaggctctttaagaaataaatagtgtaggtcagtgtatagcacagagtaggcatgtgagccatgttagttcccttttctcccaccacctgcttcatcaaacattcctgtaggtataaagtagct

SEQ ID NO: 298358 - DNA, 827 bp, Homo sapiens
ctcaagtctaccctctcctgtcttaaagtttcctcctcaatagaattaagcactaaaattttaccatcttgtacttgctctgtgtgtttgtgtacttgtaagcacattttacagttctaaactagaaatggactttgcctgggagttttatcattgacattccttgaagaaagagagaaattacattgtatgttttccagacctaccagcagctcaatggccttcccaaagaagaaacttcagggtcttgtggctgcaaccatcacgccaatgactgagaatgggtaactatcatttggggccttgaggggatcagttctcattcaaccaaaaaggagagaagttctttgtaacaacagtcacttaagaccctgcacctctgtagaactgttgccaaaaggcagcttctgtctgtcatccctctgcactgtctctgatccccaagtctgaggaggcattatatctctgaccccaaagtcagagaagcactatatcaccttgcagaaagggagaaggtgagaaatggcagcttgcctttctcccagtgtctgtagcaccacagagcaaattctccttggatttcaccacagccttggcctttctaaacagggccagtagcattggatgagaatcccattttagcataattggatatcaagcactgacctaggccctctcaggatgctgtctctggacgtcagcatgattccacttcaggctgttcatagacttgataaaaatgtcctaccctgaggaaagtgggaggttatctgcaagatggactcttttttcctgtttacagcctcatttcaacattgactagatgt

SEQ ID NO: 298359 - DNA, 613 bp, Homo sapiens
ggcggccgcggatataaagcgcggcggcggctgccgggcggagcggctgcacggacaagagcggaggcctggaaggggaaactgaagcagaaagaggttacttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagtcaaaccatcataagttggggaccatccgcacaacccaaagtagacggagtagctttagaagacagctgaaggcctggcacagtggctcacacctgtaatcccagcactttgggaggccaagtggtagctgtgcctagcagcccaggagaaagaggaagagcaaatggatgattggcttcacctaaaccaagagaaaggggtagtgaagggaggggtcgtgcaataaaactgctggtga

SEQ ID NO: 298360 - DNA, 397 bp, Homo sapiens
gagataattcatacaacagtgcttggcacagggtcaatacgcacttaggtcaaaaagtttgaactgcctttatgtcataaggcagaggcaaaaggaagatgtatttagtacaccttttacaagggactttctttttggtcttctgttgctgaatttataaacgttcatcttacccttttaaaggagatgaaatttctcatgtcttttagtattctccttcaaagttggccattttgcagttctaccttagagactctccaatgagtccaagacttctggcttctaagatccatgaaaaatcacgtccttactaggtctaaataagattcttgctgatacggcatttagattactcagctggttaataataattttttttctgttacttcccctttcc

SEQ ID NO: 298361 - DNA, 2590 bp, Homo sapiens
ggcggccgcggatataaagcgcggcggcggctgccgggcggagcggctgcacggacaagagcggaggcctggaaggggaaactgaagcagaaagaggttacttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttctaaatttgct

SEQ ID NO: 298362 - DNA, 2686 bp, Homo sapiens
ggcggccgcggatataaagcgcggcggcggctgccgggcggagcggctgcacggacaagagcggaggcctgggtgagcgcggcccgacggcacgggctaggacagacggacgcagacggcccgacgacctgggcgttcggcggaggggcgctggggcctgactcgcggaaggggaaactgaagcagaaagaggttacttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttctaaatttgct

SEQ ID NO: 298363 - DNA, 2649 bp, Homo sapiens
caagacttcatggagagcactgaacacgtactcactatgtgcctagcattgttgttaatcactttacatgaattagttcatttaattctctcaaccctatgaaatataattactattatcctcatttacagaaggggaaactgaagcagaaagaggttacttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttctaaatttgct

SEQ ID NO: 298364 - DNA, 2328 bp, Homo sapiens
ggcggccgcggatataaagcgcggcggcggctgccgggcggagcggctgcacggacaagagcggaggcctggaaggggaaactgaagcagaaagaggttacttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatgga

SEQ ID NO: 298365 - DNA, 2505 bp, Homo sapiens
ggcggccgcggatataaagcgcggcggcggctgccgggcggagcggctgcacggacaagagcggaggcctggaaggggaaactgaagcagaaagaggttacttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttctaaatttgct

SEQ ID NO: 298366 - DNA, 2663 bp, Homo sapiens
ctcaagtctaccctctcctgtcttaaagtttcctcctcaatagaattaagcactaaaattttaccatcttgtacttgctctgtgtgtttgtgtacttgtaagcacattttacagttctaaactagaaatggactttgcctgggagttttatcattgacattccttgaagaaagagagaaattacattgtatgttttccagacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttctaaatttgct

SEQ ID NO: 298367 - DNA, 2404 bp, Homo sapiens
cagctggtgggaagatgagcagggcccccgggatcctggcttcttggagaagagccccctccctttctgtgcagaagggcagccaaactgctagacacacctgccacccagaggttccgctgggaaactgcttcttacctgtctacaaggccagtcccctcacagttacccgtctttgggctgaaaggctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttctaaatttgct

SEQ ID NO: 298368 - DNA, 1806 bp, Homo sapiens
ctagaaatgttcccatcttttgttttaatcttaccctgttgtagtagttgctgttagcatatgatctccttctttgggatttttgtggagagatagacggtaccagtcatgtttcctcatttgtttttcccgtctaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttctaaatttgct

SEQ ID NO: 298369 - DNA, 2205 bp, Homo sapiens
ggcggccgcggatataaagcgcggcggcggctgccgggcggagcggctgcacggacaagagcggaggcctgggtgagcgcggcccgacggcacgggctaggacagacggacgcagacggcccgacgacctgggcgttcggcggaggggcgctggggcctgactcgcggaaggggaaactgaagcagaaagaggttacttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagacttctctttagccctgaactatcagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttctaaatttgct

SEQ ID NO: 298370 - DNA, 2443 bp, Homo sapiens
atcacagaatgctttaatgattttcagctgaaacctgagtagcagtgtagaaaggaaatcattgaaaaacctctgatttttgagaggacttattacctattaattagaagaatcactgtccctctctttatcaataccaatactgatattttgatttgtatcccaaggcagtgatatagaaggctgtctttattttttttcaaaagtagaaaagactgtgcaaggggaaacagaaaagaacaacctgcacctccatttcatgcagattcttatgctgatcaattttagaaaacagcacttatggaagttgaggatctagaaattgattcccataaatcttagccttagccatgtgctccttaggcatcctggaaggtgccccagagcttatatgcacctgagtttgaaaaccactgcactagctgataagtttacctatgtaagccagatggataaggggtgtgattcccatctttactctcttgtagaattccatcattgaagcttcttttctgcacgggcccattttgtaaagcctacatgtatgaaaagatcttaccttagcctggatggatcccagccatcttcacttggctatttttctccactctgacagaccttcagtaaatgaaggtgtgcagactttttagggtttctgtaatttgacttctacattatttacattgtttacacagttcaataatactaactatagatatgttgttcttttctagttttgtatccagagatttatcaactttgttgtcaaactaggttttggagtgtcacagaccaaagccatcatgactctggtctctgggattccaatgggcccaccccggcttccactgcagaaagcctccagggagtttactgatagtgctgaagctaaactgaagagcctggatttcctttctttcactgatttaaaggatggaaacttggaagctggtagctagtgcctctctatcaaatcagggtttgcaccttgagacataatctaccttaaatagtgcatttttttctcagggaattttagatgaacttgaataaactctcctagcaaatgaaatctcacaataagcattgaggtaccttttgtgagccttaaaaagtcttattttgtgaaggggcaaaaactctaggagtcacaactctcagtcattcatttcacagatttttttgtggagaaatttctgtttatatggatgaaatggaatcaagaggaaaattgtaattgattaattccatctgtctttaggagctctcattatctcggtctctggttcctaatcctattttaaagttgtctaattttaaaccactataatatgtcttcattttaataaatattcatttggaatctaggaaaactctgagctactgcatttaggcaggcactttaataccaaactgtaacatgtctcaactgtatacaactcaaaatacaccagctcatttggctgctcagtctaactctagaatggatgcttttgaattcatttcgatgtcaccacttttcgctctttaaaaacactgggtcaggtgaggacttgtttcagttcctataactaagtaaagggcggctttctcataacaaaggaaaaagtcttccccaaagatgaatttaagtctccacttttttctatacagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttctaaatttgct

SEQ ID NO: 298371 - DNA, 1711 bp, Homo sapiens
ggcggccgcggatataaagcgcggcggcggctgccgggcggagcggctgcacggacaagagcggaggcctggaaggggaaactgaagcagaaagaggttacttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttctaaatttgct

SEQ ID NO: 298372 - DNA, 1488 bp, Homo sapiens
attagcgggatccggaggaaagagctatgtgagggagccataggtatctctgtcctggcagttgaagaaacggagatcctaaaggctagcccagctgccccaagccacacagctagaaagagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagttttgtatccagagatttatcaactttgttgtcaaactagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcagaactttctctccatacctccttttactcttttctttctgtgtaatgtatcaacaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttctaaatttgct

SEQ ID NO: 298373 - DNA, 1657 bp, Homo sapiens
ggcggccgcggatataaagcgcggcggcggctgccgggcggagcggctgcacggacaagagcggaggcctggaaggggaaactgaagcagaaagaggttacttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactagaaaactcaaaactcaaagtttcaaagaaccaaaggactcttcctctgggcaccacaaacttccccttcctccactgagaagactgtctctcccgcaggaccctgaattattgaaatcgaaggctgacttcctttctgcagtgagcccaggggctaatgttattatcctgtcacacttgcaactagtgacttttgtttagtgatagaagatttggggaggacccaaaggactcaaactgtttaatctcccttctaacaaaccttgatataagctttctgatatcaaagtatattgacagttaacccttactgattttaaacttgactatccagtctgttaattacctaagattttgttttcatttcatctctaattgttttgatcattggcagagaaagagtatttgaaattcatatcagttttgctccttattttaatctctttgaattaaaaataaaactttttcaaaatggaaatttgaaattataagtagacttcaattatctttgctaatcctctctttaattagtcagctagttaaaagttgttatattcatatatcctcaaccctctttttgcctttgtagcttttaatttcctgaaagaagaaaatgagttgttcgtttttggttctgaggatgtgatatccgtacttactgatactaaagccaaatttaaattctaaaattaattcttgggtatccaataaacaaagaactatttttctaaatttgct

SEQ ID NO: 298374 - DNA, 1089 bp, Homo sapiens
ggcggccgcggatataaagcgcggcggcggctgccgggcggagcggctgcacggacaagagcggaggcctggaaggggaaactgaagcagaaagaggttacttaatgggctcaaggtcacctacctgacctaccagcagctcaatggccttcccaaagaagaaacttcagggtcttgtggctgcaaccatcacgccaatgactgagaatggagaaatcaacttttcagtaattggtcagtatgtggattatcttgtgaaagaacagggagtgaagaacatttttgtgaatggcacaacaggagaaggcctgtccctgagcgtctcagagcgtcgccaggttgcagaggagtgggtgacaaaagggaaggacaagctggatcaggtgataattcacgtaggagcactgagcttgaaggagtcacaggaactggcccaacatgcagcagaaataggagctgatggcatcgctgtcattgcaccgttcttcctcaagccatggaccaaagatatcctgattaatttcctaaaggaagtggctgctgccgcccctgccctgccattttattactatcacattcctgccttgacaggggtaaagattcgtgctgaggagttgttggatgggattctggataagatccccaccttccaagggctgaaattcagtgatacagatctcttagacttcgggcaatgtgttgatcagaatcgccagcaacagtttgctttcctttttggggtggatgagcaactgttgagtgctctggtgatgggagcaactggagcagtgggcagtacctataactacctgggaaaaaagacaaaccagatgttggaggcttttgaacaaaaggacttctctttagccctgaactatcagttttgtatccagagatttatcaactttgttgtcaaactaggtaagtgccacccatcttctgctttgtctgctgctggagactgtaaagaaaatggaataccatcactttctctgagggttcaacaagaacactttttaatggtctgttgcaagcagagttctgtttcccttattaaccctcggggccaaccatataaaactgtgaagt

SEQ ID NO: 298375 - DNA, 381 bp, Homo sapiens
ggcggccgcggatataaagcgcggcggcggctgccgggcggagcggctgcacggacaagagcggaggcctgggtgagcgcggcccgacggcacgggctaggacagacggacgcagacggcccgacgacctgggcgttcggcggaggggcgctggggcctgactcgcgggtgggtgagacgttgacggacccggagaaagagggaaggcagatacgctgggaaacggatctggggaaggtgtgaatgcgaaaagtgtagggacagacgggggcagaagaacttactcccccggattgtttgcagacagcatatctgccgggtctccaaaggtcctttcctcaaaatagagttagcaattgagcagaagagagcttaaagtta

SEQ ID NO: 298376 - DNA, 2116 bp, Homo sapiens
gccatgttggagagcaaaacttaataataattcttttttaaaatctgctgaagcagccccatccggcgaagttcttggcattggctactccatttgtcctagcagagtgtgactaaactggaaatgtatggagctgcattttttttttttgatggaagtcaacagctgccttactattttaccatctgacgtttttagtagggagctggggaaacgactgcccgaggaatgcggtcggaggattgtgttgctgtggacgtggttccaacattcactcctatctcattagaagaaataggtagcagcatcactcaccagtcttatgccatgacctgctgctttaacatctcctggaatgttctgggagagaacgtttcgtttgcttgtgcacgactctgttcatttttgctgtttatttaaatctgacgtatagtcatctaccacctgcggtcctggccggacgaaacacacgtgttgcatctcaaggaaaagaaacaacaaaatgctagtgaaaatgtgcttattttgatagcaatataccatcttttatgtcatttattcttcctatacttgtaaaaggttatttatctttaaaatttagcaatttgaagacactatgccttcctaagaactaatttaattctaaatatttttaacattactgaggtgaattatttatgcacttaggaagtgctaaattttaaaagctgaaacacaacagaattctaagaaatatagtccaaacgttgcatggattgcagtaatcagtgtttaaaggattcagtttctttgctgacgtactttacaaccaaataaaatcttgtcggtggctgtgttaattcccatgaaagttaagcaagatgctattaataaactgctctgctctttcttgttttctttttccaacttaaatttctgttgaatacattcaggtagaacataaagccttgttcaatcactgcctctcagttttctgcctttcctgtttttcaaagtccttttgtaatttcatttcacattttaaaggcttagacatttttattttaaatatgtgtcttttacagtcttttgtcattctgacatttctggatttttgctgttttataatttaccctttgttattcagaagcatgcttacttatagaaactaaatggtctttataaaagtaattacttaaaaagaaatcaggggaagaaagatatctatctaatctattaaatctttataaaacattacattgcagagggggagctactcctaaatattttcatgatttgcatggtttaatcagatttttttttttttttacaccatattagctaccttttcaatggagaagagacagttcacacaattccctggttagcacagatgtggactgagtgctttgtcacctgcagggtagtaacccagtgatgtttcttacagaagcacaatatgttgaaaatcctgggtgtgaccaatatggaataaagaagaaggcagaaagagagcaaatgaaaaatttcacactgtgtatattcattttttacattttgctttgacttttaaatttaggaagtccgtttttacctgagaacaaatgtttaaagttcctgcgtcactctcagtactctcactgcccctcccaaaccctatagctccttacgctgggaaagctggttttttaaaaaaataataataaaatatttaatcttattaagtgttcatttaaaatgcgtaatgctttggaaataatgggtaacagatagcgagaggatatgtttataaagtgagcatgttggtcccatttataaatatatgtatgatttataagcttttttaaaacaaagctcaaattgttggtatttttctaaaatgtgcacagctgtattttacatgaaggctctttctaatgggttgttatactgtactcaacattttggacagcacatgaagtctgccaatgtacttaataaaacatgactttgtttatttaaagtttcttgctgtgaaaaagaactccctacctgtgagttcctttatttataattcttgaaaccaaaatgtataatgtacagttttcacaactgtatctgctctaataaaaaaaagttggttattaaaaaaaaaaaa

SEQ ID NO: 298377 - DNA, 736 bp, Homo sapiens
  misc_feature (56)..(56): n is a, c, g, or t
cggacgcgtgggtccggacgcgtgggtccggacgcgtgggtcgacccacgcgtcgntgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298378 - DNA, 4342 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298379 - DNA, 4380 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaaccccaaaaaaaaaaaagaaaaactcgggctctttcggggggac

SEQ ID NO: 298380 - DNA, 4498 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaaccccaaaaaaaaaaaaaaaaaaaaaaaaaaaactcggatatatttatgttttctcttttggaggtgtttttcttactttcaaaactctaacttttgcagattttcttgaaaagtgccacggactaggaatccactcaaagggagaaatagaaaaccacccc

SEQ ID NO: 298381 - DNA, 4620 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaaccccataaaaaaaaaaacatgaagggagacatgactttattagaaaaataaaaaccaactgaggtgatgggttggtcttcagcggatgccttggtggatgaggctgcttttggctgcactggccttctcaccgcaaccgcacgccgcgcagggtccaactcaaaacagcgccatagcctcagggtctcatctgctgctgcggatgccactgtggccccatctgggctcatggtcagactcaggacccgggatgtgtgacctttgagttcagccaccttggcca

SEQ ID NO: 298382 - DNA, 4375 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggccaccgccccaagattagctaagccagggtcggagggtcagcctatggtcagagtggcgttcgaggctttgtgcctgtgagcggctgttttgcatcctgtacatgcaccaggtacgtttttgtctacgcagcactatgcctgatgaaggagttggacgtctgacttctgagtggacaccggaaagtcattaaaggggacttgagagctgt

SEQ ID NO: 298383 - DNA, 4243 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298384 - DNA, 4370 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaaccccaaaaaaaaaaaaaaaaaaaaaaaaaaaactcggatatatttatgttttctcttttggaggtgtttttcttactttcaaaactctaacttttgcagattttcttgaaaagtgccacggactaggaatccactcaaagggagaaatagaaaaccacccc

SEQ ID NO: 298385 - DNA, 4147 bp, Homo sapiens
gcggctgccgggagcccgcgggaggggcgcagggacgcggcatgggtagttttggggggaccccgctagggaagggggggcctttgttcaagcagcgagtcccggggcgccccgaacgggcagcctgggccggagagcacggcgagctgcaaggtcgcgtggcccccaagacgccagggcttgatccccgtctgcagggatatcggcttggaggaccttctccgagcgagccgggggcctgggagcacattttcagaccttcggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298386 - DNA, 4225 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccagggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298387 - DNA, 4296 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctagactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298388 - DNA, 4032 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacaacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298389 - DNA, 3795 bp, Homo sapiens
tggtgatctagagatccccattactcacgcaaagtaatatgaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298390 - DNA, 3895 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttttgtttgagacggagtctccctctgttacccggctggagtgcatggccgatcccggcccccgcacccccgcctcccggtcctcgctccccgcctcg

SEQ ID NO: 298391 - DNA, 3977 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298392 - DNA, 4063 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcgaggaacagaagtgcgaggaggaggtcttcccgctggccatgaactacctggaccgcttcctgtcgctggagcccgtgaaaaagggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298393 - DNA, 3661 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298394 - DNA, 3038 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccgtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298395 - DNA, 3504 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298396 - DNA, 3604 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaaccccagcgaaggccgcggggaaggggcccttgggtaagtgggggccgaatggagctcaagctggccaacgctatgagcacctattgggatgaggcgcgggattct

SEQ ID NO: 298397 - DNA, 3239 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcggggagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298398 - DNA, 3188 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttggagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298399 - DNA, 3164 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgtgtggaggtagcacttgctatctccacaagccgctagtaccgtgagggaacggtgaaaagaaccccgagaggggagtgaaatagattctgaaaccatttacttacaagtagtcagagcacgttaaagtgtgatggcgtacatcttgcagtatgggccgggcagttatgttaatatgcaaggttaag

SEQ ID NO: 298400 - DNA, 3040 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgtgcaaagagcaatgacctacaacgggtatacctctaggaacagctctcaccacataccgtcc

SEQ ID NO: 298401 - DNA, 2484 bp, Homo sapiens
cgcaggggccagtgctctgagccggaggtgcggcgtggcccggcccccgtgctgccggcttccccgcgcccccgggctggcccgcacctcccctgatggccgctcaccctgtgttcgcagcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccgtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298402 - DNA, 2975 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcctttccttttctttaaagaagttgaagtttaggaatcctttggtgccaactggtgtttgaaagtagggacctcagaggtttacctagagaacaggtggtttttaagggttatcttagatgtttcacaccggaaggtttttaaacactaaaatatataatttatagttaaggctaaaaagtatatttattgcagaggatgttcataaggccagtatgatttataaatgcaatctccccttgatttaaacacacagatacacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298403 - DNA, 3127 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtggccgtgtgcatgtcctttgcgcctgtgaccaccaccccaacaaaccatccagtgacaaaccatccagtggaggtttgtcgggcaccagccagcgtagcagggtcgggaaaggccacctgtcccactcctacgatacgctactataaagagaagacgaaatagtgacataatatattctatttttatactcttcctatttttgtagtgacctgtttatgagatgctggttttctacccaacggccctgcagccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtgtgggccactgtggtggcagtggaggtggggtgtttgggaggctgcgtgccagtcaagaagaaaaaggtttgcattctcacattgccaggatgataagttcaactgagccttaaaccagcaagttttttattaagggtttcaagaggggagggggtgtgagaacatggagtagagctcatgcttcaaagggcaaaaaacagaacaaagatcacttgcttctgagggaacaggagaaaaggcaacacagaactactgataagggtccatgttcagcggtgcacgtattatcttgataaacatcttgaacaaaaaatagggaaacgtctgaccacaaattcaccagggtggagtttttccccaccgtagtaagcctgagggtactgcaggagatcagggcgtatctcagtccttatctcaaccacgtaagacagacattcccagagcagctgtttatagacctctccccaggaatgcattcctttcccagggtattaatattaatattgcttgctaggaaaagaatttagcgatatcctccctacttgcatgtccttttataggctctctgcaagaagaaaaatatggctttttttgcctgaccctgcaggcagtcagaccttatggttgtcttcccttgttccctaaaatcgctgttattctgttttttctcaaggtgcactgatttcatattgttcaaacacacgttttacaatcaatttgtacagttaacacaattatcacggtggtcctgaggtgacatacatcctcagcttacgaagataacaggattaagagatgagagtaagacaggcgtaagaaattataaaagtattaattt

SEQ ID NO: 298404 - DNA, 1809 bp, Homo sapiens
ctcccgacctcaggcttacacggttcacagtgccatactccctggaatcagtaatgtgagggtgcgtgattctggctacgtatcagatttcctgtgggatttcacacatagcccacacacacacacacacacacacacaaaccttctgcctttgatgttacagatttaatacagtttatttttaaagatagatccttttataggtgagaaaaaaacaatctggaagaaaaaaaccacacaaagacattgattcagcctgtttggcgtttcccagagtcatctgattggacaggcatgggtgcaaggaaaattagggtactcaacctaagttcggttccgatgaattcttatcccctgccccttcctttaaaaaacttagtgacaaaatagacaatttgcacatcttggctatgtaattcttgtaatttttatttaggaagtgttgaagggaggtggcaagagtgtggaggctgacgtgtgagggaggacaggcgggaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298405 - DNA, 3174 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaggagcccgagccccgacgagtccccgcgcctcatccgcccgcgtccggtccgcgttcctccgccccaccatggctcggggccccggcctcgcgccgccaccgctgcggctgccgctgctgctgctggtgctggcggcggtgaccggccacacggccgcgcaggacaactgcacgtgtcccaccaacaagatgaccgtgtgcagccccgacggccccggcggccgctgccagtgccgcgcgctgggctcgggcatggcggtcgactgctccacgctgacctccaagtgtctgctgctcaaggcgcgcatgagcgcccccaagaacgcccgcacgctggtgcggccgagtgagcacgcgctcgtggacaacgatggcctctacgaccccgactgcgaccccgagggccgcttcaaggcgcgccagtgcaaccagacgtcggtgtgctggtgcgtgaactcggtgggcgtgcgccgcacggacaagggcgacctgagcctacgctgcgatgagctggtgcgcacccaccacatcctcattgacctgcgccaccgccccaccgccggcgccttcaaccactcagacctggacgccgagctgaggcggctcttccgcgagcgctatcggctgcaccccaagttcgtggcggccgtgcactacgagcagcccaccatccagatcgagctgcggcagaacacgtctcagaaggccgccggtgacgtggatatcggcgatgccgcctactacttcgagagggacatcaagggcgagtctctattccagggccgcggcggcctggacttgcgcgtgcgcggagaacccctgcaggtggagcgcacgctcatctattacctggacgagattcccccgaagttctccatgaagcgcctcaccgccggcctcatcgccgtcatcgtggtggtcgtggtggccctcgtcgccggcatggccgtcctggtgatcaccaaccggagaaagtcggggaagtacaagaaggtggagatcaaggaactgggggagttgagaaaggaaccgagcttgtaggtacccggcggggcaggggatggggtggggtaccggatttcggtatcgtcccagacccaagtgagtcacgcttcctgattcctcggcgcaaaggagacgtttatcctttcaaattcctgccttccccctcccttttgcgcacacaccaggtttaatagatcctggcctcagggtctcctttctttctcacttctgtcttgaaggaagcatttctaaaatgtatcccctttcggtccaacaacaggaaacctgactggggcagtgaaggaagggatggcatagcgttatgtgtaaaaaacaagtatctgtatgacaacccgggatcgtttgcaagtaactgaatccattgcgacattgtgaaggcttaaatgagtttagatgggaaatagcgttgttatcgccttgggtttaaattatttgatgagttccacttgtatcatggcctacccgaggagaagaggagtttgttaactgggcctatgtagtagcctcatttaccatcgtttgtattactgaccacatatgcttgtcactgggaaagaagcctgtttcagctgcctgaacgcagtttggatgtctttgaggacagacattgcccggaaactcagtctatttattcttcagcttgcccttactgccactgatattggtaatgttcttttttgtaaaatgtttgtacatatgttgtctttgataatgttgctgtaattttttaaaataaaacacgaatttaataaaatatgggaaaggcacaaaaaaaa

SEQ ID NO: 298406 - DNA, 1394 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacaactccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgccctctgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctccactgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagagaatctacttcaccgggtccat

SEQ ID NO: 298407 - DNA, 1369 bp, Homo sapiens
  misc_feature (56)..(56): n is a, c, g, or t
cggacgcgtgggtccggacgcgtgggtccggacgcgtgggtcgacccacgcgtcgnaggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298408 - DNA, 1350 bp, Homo sapiens
  misc_feature (31)..(32): n is a, c, g, or t
tgataccctcatggaggatgtcagcaccatnnaggataggaggtgtgaggaggaggctcccgaggggaaggggcggtgcccacaccggggacaggccgcagctccattttcttattgcgctgctaccgttgacttccaggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaatttggacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaacccca

SEQ ID NO: 298409 - DNA, 988 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtgcggggcttcgggcggctctcttaagacttccctgcaacttgttgcccagacccacgtttctttgctactcacccccctcccttctctcccgctagaactttgaagtttgccgtggtgtttctagggatccgtattttcaaaataaaaattgcgggtattttctgaaggaggaaggggtgggggtgggggtgctaaaagtagcgtttcgtgggaggggagaagggggtccgggaggggtgccttcgggagaagccagtgccaggggcaccccaatgggcccgagggtgcgggctggcaggctgggtgcgctttgtgtcccccgcctgcgccccagcccggctgcgcctcagcggccgggagccgccaactccggggggagggggcatagatttgatttttaaattaatatccatggacacgtatgcaagggccgctcgtgccagtattatgcgccatctttgctcttttattgcaaagcaaaagtgtttattaataattgggggcagggtgggggcggggagcggccg

SEQ ID NO: 298410 - DNA, 793 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagcccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaacatgaaagtctagaaataaaactggtaaaaccccaaaaaaaaaaaaaaaaaaaaaaaaaaaactcggatatatttatgttttctcttttggaggtgtttttcttactttcaaaactctaacttttgcagattttcttgaaaagtgccacggactaggaatccactcaaagggagaaatagaaaaccacccc

SEQ ID NO: 298411 - DNA, 749 bp, Homo sapiens
  misc_feature (56)..(56): n is a, c, g, or t
cggacgcgtgggtccggacgcgtgggtccggacgcgtgggtcgacccacgcgtcgnggactacaggggagttttgttgaagttgcaaagtcctggagcctccagagggctgtcggcgcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtgccttcgggagaagccagtgccaggggcaccccaatgggcccgagggtgcgggctggcaggctgggtgcgctttgtgtcccccgcctgcgccccagcccggctgcgcctcagcggccgggagccgccaactccggggggagggggcatagatttgatttttaaattaatatccatggacacgtatgcaagggccgctcgtgccagtattatgcgccatctttgctcttttattgcaaagcaaaagtgtttattaataattgggggcagggtgggggcggggagcggccg

SEQ ID NO: 298412 - DNA, 400 bp, Homo sapiens
agcggccgccgggcgctggggccgcagctaagggccgcgcggctgccgggagcccgcgggaggggcgcagggacgcggcatgggtagttttggggggaccccgctagggaagggggggcctttgttcaagcagcgagtcccggggcgccccgaacgggcagcctgggccggagagcacggcgagctgcaaggtcgcgtggcccccaagacgccagggcttgatccccgtctgcagggatatcggcttggaggaccttctccgagcgagccgggggcctgggagcacattttcagaccttcggtgggcgcctgaggggcccgcaagtattttaaaataatttttgaaagtgcggcgtggtgcccttgcgagagggaaacgccgcccgcgcccagggggaag

SEQ ID NO: 298413 - DNA, 5229 bp, Homo sapiens
ctggttctcaacttcttttgaaataatgttcatagagaaggagggctgtctgagattcgagggaaacaagctctcaggacttccggtcgccatgatggctgtgggcggtaaacgcggttagtgcaagcatctgggccatcttcaatggtaaaaaagatacagtaaagacataaataccacatttgacaaatggaaaaaaaggagtgtccagaaaagagtagcagcagtgaggaagagctgccgagacgggtatacagggagctaccctgtgtttctgagaccctttgtgacatctcacattttttccaagaagatgatgagacagaggcagagccattattgttccgtgctgttcctgagtgtcaactatctgggggggacattcccaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaggacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcttctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaatattatattttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttgtctgtgtcgtcccactgagtgcattcaccaccttttaaattttggtcactgtatgtatcagttctaaaatttccattttgttctctatattttaaatttcttggcttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctcctgagtagctgggattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtattttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaatttttttaaaaaatatttttagtagagacagggtttcaccattttggccaggatggtctcgatctcctgacctcatgatccacccgcctcggccttccaaagtgctgggattacaggcatgagccaccgtgcctggcctcatttgagtatttttataatgtctcttttaaagtctttgtcagataattccactgtacatgttattcagtgtttggtgtccactgagttgtcatttgccagacaagtggagatttttgcagctcatccttgtattctcagtagttccgatatgtaccctcgacatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtctttatatgctcagattctgcagctccatcctcttcatgattgtgatcgtaaggacagtggaattttgcagttgtctataccttatcttgaagtagaactaaattgttacatttgaagaatgtacttcataaatttacaaaaataaaaaaataggttaatgttattaaaacaaaaaggcacaca

SEQ ID NO: 298414 - DNA, 1951 bp, Homo sapiens
  misc_feature (679)..(679): n is a, c, g, or t
  misc_feature (706)..(706): n is a, c, g, or t
tatttattttattattttattatttgttttcgagatgaagaacaatcaaaggaaaatgatggacggaaattaacaatcattcttgggcggggggaaaaactccacccacaattcctaagtaaaaagggttacacacattctcggcataataagtctctctcaggccaaatgtgttcatgtgaacactatgaaggcattccagctgaggtcaggaaaataccaagtatgaccttccctatttaagttaaaatattggaagcttattccaaaatattggaataaatttgaaatacagtgattgaatggaaggacattaaattataactcattagacatgttattttactctatagacaaacacaacaaatcacctgaaataagctacaaaagataaaccagtaagttagagaaataatctttttttttttttgagatggagtctccctctgttgcttaggccagagtgcagtggcgcagtcttggctcactgcaacctctgcttcctgagttctagtgagtctcctcctcagcctcccaagtagctgggattacaggcatgtgccaccatgcctggctaattttttttgtatttttagtagagatggggtttcaccatgttggacatgctggtcttgaactcctgacctcaggtgatctgcctgcctcaggttcccaagtnctgggattataggcttgagccattgcncctggccagaagaatcttaatgtacaaaaatgaataggtttttaatacaacagactatcccaattccttgaaagaagaaaatacacccattaaaacagaaactatggtgcctagaattaaactgcacaaaaaactacatgacccatataatttttttatgttgaaataattttaaacatgcaaaattagcaaagattcatataaatcctcaaccagcctatcctgatgttagctatatatataattgtattatatgtataatagttgttatatataaaactgtatatatacatttattgtattataatcatatatatacatttattgcattatatataatatacaactgtatatgtaattgtaatataataattatatacataatagtatatgtaatacaagttatccaaccaggaaattgatgtcaacgtatcttaccattacctaatgtgcagaccttatttgaattttgtcaatatttctcttaacgtcctctttcttctccaagatcgaattgaggatctcacattgcactcagttgttatgtccttagattcctccaggctgtgaccgtttcttattcttcccttgtcttttgtgattgtgacacttttgctgagcatggccaattattttacagaatgtttatcaatttggatttctttgatgttttctcacgattaggctgaggtcatgcatgtttgtcttctgtgttcagtcaacatgccccatcctttttgaaatatttcttcatgttctggcgtcacaatttgttccaatgttatcttatatattcctgccccagccctcgaagtaaccatttctccacagatacttcaaaatagtatttagaaaccaaggccgggcacagtggctcacgcctgtaatcccagcactttgggaggccgaggcgggctgatctcgaggtcaagagacggagaccatcctgaccaacatggtgaaactccgtctttactaaaaatacaaaaaattagccgagcgtggtggcatgcgcctgtaattccagctactcgggaggctgaggcaagagaatcgcttgaacctggaaggcagaggttgcagtgagccgagattgctccattacactccagcctgggtgacagacggagacttcatcaggtgagtttcaggagccctagcgtacaggaaggagaaacggaggcttgttggtaggacaccgccaggctgctctgtgttctgttcctcttagtcagcaaggaagga

SEQ ID NO: 298415 - DNA, 233 bp, Homo sapiens
gacagcctcataggaacttctccctttcttctcaagtgaccaagaggaacagaacacagagcagcctggcagtgtccaagcaacaagcctccgctcctccttcctgcaccctggggctcctgaaactcacatgccccaaagtggaactcacccaaatgtctatcgtctgctgaatggataagagaatatgtgatgtctccatacggtggaatattattcagccatgaaagcaa

SEQ ID NO: 298416 - DNA, 5393 bp, Homo sapiens
aaaagaagttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgagaaggagggctgtctgagattcgagggaaacaagctctcaggacttccggtcgccatgatggctgtgggcggtaaacgcggttagtgcaagcatctgggccatcttcaatggtaaaaaagatacagtaaagacataaataccacatttgacaaatggaaaaaaaggagtgtccagaaaagagtagcagcagtgaggaagagctgccgagacgggtatacagggagctaccctgtgtttctgagaccctttgtgacatctcacattttttccaagaagatgatgagacagaggcagagccattattgttccgtgctgttcctgagtgtcaactatctgggggggacattcccaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaggacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcttctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaatattatattttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttgtctgtgtcgtcccactgagtgcattcaccaccttttaaattttggtcactgtatgtatcagttctaaaatttccattttgttctctatattttaaatttcttggcttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctcctgagtagctgggattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtattttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaatttttttaaaaaatatttttagtagagacagggtttcaccattttggccaggatggtctcgatctcctgacctcatgatccacccgcctcggccttccaaagtgctgggattacaggcatgagccaccgtgcctggcctcatttgagtatttttataatgtctcttttaaagtctttgtcagataattccactgtacatgttattcagtgtttggtgtccactgagttgtcatttgccagacaagtggagatttttgcagctcatccttgtattctcagtagttccgatatgtaccctcgacatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtctttatatgctcagattctgcagctccatcctcttcatgattgtgatcgtaaggacagtggaattttgcagttgtctataccttatcttgaagtagaactaaattgttacatttgaagaatgtacttcataaatttacaaaaataaaaaaataggttaatgttattaaaacaaaaaggcacaca

SEQ ID NO: 298417 - DNA, 5543 bp, Homo sapiens
aaaagaagttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgagaaggagggctgtctgagattcgagggaaacaagctctcaggacttccggtcgccatgatggctgtgggcggtaaacgcggttagtgcaagcatctgggccatcttcaatggtaaaaaagatacagtaaagacataaataccacatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacggtatacagggagctaccctgtgtttctgagaccctttgtgacatctcacattttttccaagaagatgatgagacagaggcagagccattattgttccgtgctgttcctgagtgtcaactatctgggggggacattcccaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaggacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcttctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaatattatattttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttgtctgtgtcgtcccactgagtgcattcaccaccttttaaattttggtcactgtatgtatcagttctaaaatttccattttgttctctatattttaaatttcttggcttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctcctgagtagctgggattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtattttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaatttttttaaaaaatatttttagtagagacagggtttcaccattttggccaggatggtctcgatctcctgacctcatgatccacccgcctcggccttccaaagtgctgggattacaggcatgagccaccgtgcctggcctcatttgagtatttttataatgtctcttttaaagtctttgtcagataattccactgtacatgttattcagtgtttggtgtccactgagttgtcatttgccagacaagtggagatttttgcagctcatccttgtattctcagtagttccgatatgtaccctcgacatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtctttatatgctcagattctgcagctccatcctcttcatgattgtgatcgtaaggacagtggaattttgcagttgtctataccttatcttgaagtagaactaaattgttacatttgaagaatgtacttcataaatttacaaaaataaaaaaataggttaatgttattaaaacaaaaaggcacaca

SEQ ID NO: 298418 - DNA, 5477 bp, Homo sapiens
gacagcctcataggaacttctccctttcttctcaagtgaccaagaggaacagaacacagagcagcctggcagtgtccaagcaacaagcctccgctcctccttcctgcaccctggggctcctgaaactcacatgagaaggagggctgtctgagattcgagggaaacaagctctcaggacttccggtcgccatgatggctgtgggcggtaaacgcggttagtgcaagcatctgggccatcttcaatggtaaaaaagatacagtaaagacataaataccacatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacggtatacagggagctaccctgtgtttctgagaccctttgtgacatctcacattttttccaagaagatgatgagacagaggcagagccattattgttccgtgctgttcctgagtgtcaactatctgggggggacattcccaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaggacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcttctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaatattatattttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttgtctgtgtcgtcccactgagtgcattcaccaccttttaaattttggtcactgtatgtatcagttctaaaatttccattttgttctctatattttaaatttcttggcttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctcctgagtagctgggattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtattttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaatttttttaaaaaatatttttagtagagacagggtttcaccattttggccaggatggtctcgatctcctgacctcatgatccacccgcctcggccttccaaagtgctgggattacaggcatgagccaccgtgcctggcctcatttgagtatttttataatgtctcttttaaagtctttgtcagataattccactgtacatgttattcagtgtttggtgtccactgagttgtcatttgccagacaagtggagatttttgcagctcatccttgtattctcagtagttccgatatgtaccctcgacatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtctttatatgctcagattctgcagctccatcctcttcatgattgtgatcgtaaggacagtggaattttgcagttgtctataccttatcttgaagtagaactaaattgttacatttgaagaatgtacttcataaatttacaaaaataaaaaaataggttaatgttattaaaacaaaaaggcacaca

SEQ ID NO: 298419 - DNA, 5432 bp, Homo sapiens
aaaagaagttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgggtaaaaaagatacagtaaagacataaataccacatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacggtatacagggagctaccctgtgtttctgagaccctttgtgacatctcacattttttccaagaagatgatgagacagaggcagagccattattgttccgtgctgttcctgagtgtcaactatctgggggggacattcccaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaggacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcttctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaatattatattttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttgtctgtgtcgtcccactgagtgcattcaccaccttttaaattttggtcactgtatgtatcagttctaaaatttccattttgttctctatattttaaatttcttggcttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctcctgagtagctgggattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtattttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaatttttttaaaaaatatttttagtagagacagggtttcaccattttggccaggatggtctcgatctcctgacctcatgatccacccgcctcggccttccaaagtgctgggattacaggcatgagccaccgtgcctggcctcatttgagtatttttataatgtctcttttaaagtctttgtcagataattccactgtacatgttattcagtgtttggtgtccactgagttgtcatttgccagacaagtggagatttttgcagctcatccttgtattctcagtagttccgatatgtaccctcgacatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtctttatatgctcagattctgcagctccatcctcttcatgattgtgatcgtaaggacagtggaattttgcagttgtctataccttatcttgaagtagaactaaattgttacatttgaagaatgtacttcataaatttacaaaaataaaaaaataggttaatgttattaaaacaaaaaggcacaca

SEQ ID NO: 298420 - DNA, 2179 bp, Homo sapiens
aaaagaagttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgagaaggagggctgtctgagattcgagggaaacaagctctcaggacttccggtcgccatgatggctgtgggcggtaaacgcggttagtgcaagcatctgggccatcttcaatggtaaaaaagatacagtaaagacataaataccacatttgacaaatggaaaaaaaggagtgtccagaaaagagtagcagcagtgaggaagagctgccgagacgggtatacagggagctaccctgtgtttctgagaccctttgtgacatctcacattttttccaagaagatgatgagacagaggcagagccattattgttccgtgctgttcctgagtgtcaactatctgggggggacattcccaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaggacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgttccgctgcagcggtacaagcaacataagatgaactagcaataatagaaagttttttaacccaactaaactatagcagatggctgcgagaataccatctggtagctctgtgaactgatactactttttgggatataatttgacatttatgtcataatccat

SEQ ID NO: 298421 - DNA, 1869 bp, Homo sapiens
aaaagaagttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgagaaggagggctgtctgagattcgagggaaacaagctctcaggacttccggtcgccatgatggctgtgggcggtaaacgcggttagtgcaagcatctgggccatcttcaatggtaaaaaagatacagtaaagacataaataccacatttgacaaatggaaaaaaaggagtgtccagaaaagagtagcagcagtgaggaagagctgccgagacgggtatacagggagctaccctgtgtttctgagaccctttgtgacatctcacattttttccaagaagatgatgagacagaggcagagccattattgttccgtgctgttcctgagtgtcaactatctgggggggacattcccaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaggacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagtaagaacctcattgtcctggagatcatcgagcacccctttcaggtcccccatcctggcttggagttgccggtggttctccttcaca

SEQ ID NO: 298422 - DNA, 5327 bp, Homo sapiens
ctggctgtgtccacattgaacgtgggcataatacaaagagaagaaggagagatgtcaagacacatttggctcaagggagtgtgttatctctattatttataaatgtggataaaaatatcttcattcaaaatgtcttctatttcttgatagtctagatccgcccagtctaagagaactttctgtgatgacgggagtgttccattctctgctacacagtgttatagccgtgagtgatatgtagctgttgagcacttgaaatatggatagtgcaactgagaaactaaagtttacctaagtttaattcatacaaatttaaatagcatatccgggtagcggctactctacgggacagtgcagctctagttttcaataacatcgtcttcatcttcatcaactgattcttgatgtttttcatctttttgtaacatggggatcccaacctccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaggacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcttctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaatattatattttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttgtctgtgtcgtcccactgagtgcattcaccaccttttaaattttggtcactgtatgtatcagttctaaaatttccattttgttctctatattttaaatttcttggcttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctcctgagtagctgggattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtattttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaatttttttaaaaaatatttttagtagagacagggtttcaccattttggccaggatggtctcgatctcctgacctcatgatccacccgcctcggccttccaaagtgctgggattacaggcatgagccaccgtgcctggcctcatttgagtatttttataatgtctcttttaaagtctttgtcagataattccactgtacatgttattcagtgtttggtgtccactgagttgtcatttgccagacaagtggagatttttgcagctcatccttgtattctcagtagttccgatatgtaccctcgacatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtctttatatgctcagattctgcagctccatcctcttcatgattgtgatcgtaaggacagtggaattttgcagttgtctataccttatcttgaagtagaactaaattgttacatttgaagaatgtacttcataaatttacaaaaataaaaaaataggttaatgttattaaaacaaaaaggcacaca

SEQ ID NO: 298423 - DNA, 5185 bp, Homo sapiens
ctggctgtgtccacattgaacgtgggcataatacaaagagaagaaggagagatgtcaagacacatttggctcaagggagtgtgttatctctattatttataaatgtggataaaaatatcttcattcaaaatgtcttctatttcttgatagtctagatccgcccagtctaagagaactttctgtgatgacgggagtgttccattctctgctacacagtgttatagccgtgagtgatatgtagctgttgagcacttgaaatatggatagtgcaactgagaaactaaagtttacctaagtttaattcatacaaatttaaatagcatatccgggtagcggctactctacgggacagtgcagctctagttttcaataacatcgtcttcatcttcatcaactgattcttgatgtttttcatctttttgtaacatggggatcccaacctccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaagtggatctccagcttgtagctgcatcagcccctcctcctttctcaggtgcagcctttgtgaaggagaaccaccggcaactccaagccaggatgggggacctgaaaggggtgctcgatgatctccaggacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcttctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaatattatattttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttgtctgtgtcgtcccactgagtgcattcaccaccttttaaattttggtcactgtatgtatcagttctaaaatttccattttgttctctatattttaaatttcttggcttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctcctgagtagctgggattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtattttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaatttttttaaaaaatatttttagtagagacagggtttcaccattttggccaggatggtctcgatctcctgacctcatgatccacccgcctcggccttccaaagtgctgggattacaggcatgagccaccgtgcctggcctcatttgagtatttttataatgtctcttttaaagtctttgtcagataattccactgtacatgttattcagtgtttggtgtccactgagttgtcatttgccagacaagtggagatttttgcagctcatccttgtattctcagtagttccgatatgtaccctcgacatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtctttatatgctcagattctgcagctccatcctcttcatgattgtgatcgtaaggacagtggaattttgcagttgtctataccttatcttgaagtagaactaaattgttacatttgaagaatgtacttcataaatttacaaaaataaaaaaataggttaatgttattaaaacaaaaaggcacaca

SEQ ID NO: 298424 - DNA, 5584 bp, Homo sapiens
aaaagaagttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgagaaggagggctgtctgagattcgagggaaacaagctctcaggacttccggtcgccatgatggctgtgggcggtaaacgcggttagtgcaagcatctgggccatcttcaatggtaaaaaagatacagtaaagacataaataccacatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacggtatacagggagctaccctgtgtttctgagaccctttgtgacatctcacattttttccaagaagatgatgagacagaggcagagccattattgttccgtgctgttcctgagtgtcaactatctgggggggacattcccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaggacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcttctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaatattatattttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttgtctgtgtcgtcccactgagtgcattcaccaccttttaaattttggtcactgtatgtatcagttctaaaatttccattttgttctctatattttaaatttcttggcttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctcctgagtagctgggattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtattttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaatttttttaaaaaatatttttagtagagacagggtttcaccattttggccaggatggtctcgatctcctgacctcatgatccacccgcctcggccttccaaagtgctgggattacaggcatgagccaccgtgcctggcctcatttgagtatttttataatgtctcttttaaagtctttgtcagataattccactgtacatgttattcagtgtttggtgtccactgagttgtcatttgccagacaagtggagatttttgcagctcatccttgtattctcagtagttccgatatgtaccctcgacatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtctttatatgctcagattctgcagctccatcctcttcatgattgtgatcgtaaggacagtggaattttgcagttgtctataccttatcttgaagtagaactaaattgttacatttgaagaatgtacttcataaatttacaaaaataaaaaaataggttaatgttattaaaacaaaaaggcacaca

SEQ ID NO: 298425 - DNA, 5323 bp, Homo sapiens
aaaagaagttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgggtaaaaaagatacagtaaagacataaataccacatttgacaaatggaaaaaaaggagtgtccagaaaagagtagcagcagtgaggaagagctgccgagacgggtatacagggagctaccctgtgtttctgagaccctttgtgacatctcacattttttccaagaagatgatgagacagaggcagagccattattgttccgtgctgttcctgagtgtcaactatctgggggggacattcccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaggacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcttctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaatattatattttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttgtctgtgtcgtcccactgagtgcattcaccaccttttaaattttggtcactgtatgtatcagttctaaaatttccattttgttctctatattttaaatttcttggcttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctcctgagtagctgggattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtattttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaatttttttaaaaaatatttttagtagagacagggtttcaccattttggccaggatggtctcgatctcctgacctcatgatccacccgcctcggccttccaaagtgctgggattacaggcatgagccaccgtgcctggcctcatttgagtatttttataatgtctcttttaaagtctttgtcagataattccactgtacatgttattcagtgtttggtgtccactgagttgtcatttgccagacaagtggagatttttgcagctcatccttgtattctcagtagttccgatatgtaccctcgacatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtctttatatgctcagattctgcagctccatcctcttcatgattgtgatcgtaaggacagtggaattttgcagttgtctataccttatcttgaagtagaactaaattgttacatttgaagaatgtacttcataaatttacaaaaataaaaaaataggttaatgttattaaaacaaaaaggcacaca

SEQ ID NO: 298426 - DNA, 4967 bp, Homo sapiens
  misc_feature (111)..(111): n is a, c, g, or t
cagtcagctgttattatcttacttgaccggatacactggttagaagctctatcccatttcctgaaattcagtactcttgtaggaaaatatttctccgttccaaggacgggncctcactgtcaccagccacgctcctcatccaaatccgcatccagcgctcctgagggcccacctcactcgccttggggttctccgagtgccagtccacatcccctgcagagccctctcctcctctggagtcaggtggtgggagtaccagccccacagccaaccgtggactagtactagtccacggttggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaggacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcttctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaatattatattttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttgtctgtgtcgtcccactgagtgcattcaccaccttttaaattttggtcactgtatgtatcagttctaaaatttccattttgttctctatattttaaatttcttggcttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctcctgagtagctgggattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtattttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaatttttttaaaaaatatttttagtagagacagggtttcaccattttggccaggatggtctcgatctcctgacctcatgatccacccgcctcggccttccaaagtgctgggattacaggcatgagccaccgtgcctggcctcatttgagtatttttataatgtctcttttaaagtctttgtcagataattccactgtacatgttattcagtgtttggtgtccactgagttgtcatttgccagacaagtggagatttttgcagctcatccttgtattctcagtagttccgatatgtaccctcgacatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtctttatatgctcagattctgcagctccatcctcttcatgattgtgatcgtaaggacagtggaattttgcagttgtctataccttatcttgaagtagaactaaattgttacatttgaagaatgtacttcataaatttacaaaaataaaaaaataggttaatgttattaaaacaaaaaggcacaca

SEQ ID NO: 298427 - DNA, 4691 bp, Homo sapiens
aaaagaagttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgggtaaaaaagatacagtaaagacataaataccacatttgacaaatggaaaaaaaggagtgtccagaaaagagtagcagcagtgaggaagagctgccgagacgggtatacagggagctaccctgtgtttctgagaccctttgtgacatctcacattttttccaagaagatgatgagacagaggcagagccattattgttccgtgctgttcctgagtgtcaactatctgggggggacattcccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacaggcgatagatgatgaggaagatcgcttccatggtgtgcgcctgcagacttcgcccccaatggaacccctgaactttggttccagttatattgtgtctaattctgctaacctgaaagtaatgcccaagtggatctccagcttgtagctgcatcagcccctcctcctttctcaggtgcagcctttgtgaaggagaaccaccggcaactccaagccaggatgggggacctgaaaggggtgctcgatgatctccaggacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcttctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaatattatattttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttgtctgtgtcgtcccactgagtgcattcaccaccttttaaattttggtcactgtatgtatcagttctaaaatttccattttgttctctatattttaaatttcttggcttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctcctgagtagctgggattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtattttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaatttttttaaaaaatatttttagtagagacagggtttcaccattttggccaggatggtctcgatctcctgacctcatgatccacccgcctcggccttccaaagtgctgggattacaggcatgagccaccgtgcctggcctcatttgagtatttttataatgtctcttttaaagtctttgtcagataattccactgtacatgttattcagtgtttggtgtccactgagttgtcatttgccagacaagtggagatttttgcagctcatccttgtattctcagtagttccgatatgtaccctcgacatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtctttatatgctcagattctgcagctccatcctcttcatgattgtgatcgtaaggacagtggaattttgcagttgtctataccttatcttgaagtagaactaaattgttacatttgaagaatgtacttcataaatttacaaaaataaaaaaataggttaatgttattaaaacaaaaaggcacaca

SEQ ID NO: 298428 - DNA, 4622 bp, Homo sapiens
cttgttttctgaagaaactagagatttgcatgagctaagcttttcctaattctgtcctgcataaggggctttcttgctccccagggcagctttttttaggaatcctggggagactgggtgcaaaacagagagggacctgaaatggcttatctgaccccggcttcccagcgaggctcagagagacctgatggggctgctttggaagctttcttgcttctctatagaatctcggattctgagctggtcgcatcattaatgaggggcctcaaaaccctcaaaatctaagacgtttgtattcagttggtagctcagatagtttttctctgactcatgtggtgttgacagctaggttattcttcccttcctggtataaaagcatttcctaacattgtaaatgtaaagagctgtttacctctctccctctgtttcccactcaaccagccatgacattgcacaggaaacgggttaagttccattggccagttcactgtagggagccgggcctttccaccctccactgcttcaagtcaactgatgtgtttcctctaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggtgcagcctttgtgaaggagaaccaccggcaactccaagccaggatgggggacctgaaaggggtgctcgatgatctccaggacaatgaggttcttactgagaatgagaaggagctggtggagcaggaaaagacacggcagagcaagaatgaggccttgctgagcatggtggagaagaaaggggacctggccctggacgtgctcttcagaagcattagtgaaagggacccttacctcgtgtcctatcttagacagcagaatttgtaaaatgagtcagttaggtagtctggaagagagaatccagcgttctcattggaaatggataaacagaaatgtgatcattgatttcagtgttcaagacagaagaagactgggtaacatctatcacacaggctttcaggacagacttgtaacctggcatgtacctattgactgtatcctcatgcattttcctcaagaatgtctgaagaaggtagtaatattccttttaaattttttccaaccattgcttgatatatcactattttatccattgacatgattcttgaagacccaggataaaggacatccggataggtgtgtttatgaaggatggggcctggaaaggcaacttttcctgattaatgtgaaaaataattcctatggacactccgtttgaagtatcaccttctcataactaaaagcagaaaagctaacaaaagcttctcagctgaggacactcaaggcatacatgatgacagtcttttttttttttgtatgttaggactttaacactttatctatggctactgttattagaacaatgtaaatgtatttgctgaaagagagcacaaaaatgggagaaaatgcaaacatgagcagaaaatattttcccactggtgtgtagcctgctacaaggagttgttgggttaaatgttcatggtcaactccaaggaatactgagatgaaatgtggtaaatcaactccacagaaccaccaaaaagaaaatgagggtaattcagcttattctgagacagacattcctggcaatgtaccatacaaaaaataagccaactctgacatttggattctaccatagactctgtcattttgtagccatttcagctgtcttttgattaatgttttcgtggcacacatatttccatccttttatgtttaatctgtttaaaacaagttcctagtagacaccatctggttgagtcagttttttttatggtgtattttgaacccattctgatagtctcttttaactggaagatttcaattacttacgttaatgtaattattaatatgttaggatttatcctcagtcagccagtttgttatgtcttttctattctactgttatcacatttgtaccacttaaagtggaatctaggcactttatcaccatttagatcctattaccttttctcatctaggatatagttatcttctacataatctttctgtatcttaaaacccatcaataaattattatatattttctacttttaatcactcagaagatttaaaaaactcatgagaagagtaatctgttatgtttttccagatatttaccatttctgttgctcttccttcattattttccaaatttcgttctgcaaatttccacttcttctgatagacgttttttagttcttttagagtggttctgataggtacagattctcttattttttgcttcctctgaggacatctttttctcaccttcattctcagtgatgttttttgcttgtagtatttttagttgacattgttttctgttcagcagtttccttttagcttccgtatttcctgatgagaaatctgcagtcattcaaattgttgtttccctgtatgtagtgtgtcatttttctgtcagatttcaaggtatttatctttagtttttagccatttcattatgttggggatgagtttccttgttttattccctttggaatttgctccaattcataaatttgcagttttatgtcttttaccaaacttagaggttttcagcctaatttctaaaaatactttttattagcctgattttcatctttataggaaatagtttaagtgatgacaagttccaatagcttatatgcccagaaggccttcaaaataagaattttgaaagaatacagaaaacaaacttttatatccttctcatgtcttctactgtaaaattcatatgctttgctactctaaacctagtttgaaatcaacagtcttgagaatagatgaaaattttgatgaatagtggaattcttttaaatggaaacctcttacatgtgattttccttgccatctagaaataaaccatagtatttatgttgaatcaatcaatattatattttgtttttttcctcctcttctgagactcttattgtggaaatgttagacttttatgttttcctaaatgtccctgatattctacttatttagaacatcttttcattttttccattattctgattgggtaattttaatttgtctattttcaaatttgctggagtgttcacctgttgttgtctgtgtcgtcccactgagtgcattcaccaccttttaaattttggtcactgtatgtatcagttctaaaatttccattttgttctctatattttaaatttcttggcttatattctattttcctgcaaatgtgtcagcatttgcttgtttgagctttttttttttcaagacagggtctcaactctgttacccaggctggagtgcagtggtgcgatctcagctcactgcaacctctgcctcctggttcaagcgattattgtgcctcagcctcctgagtagctgggattacaggcatgcaccaccacagcccagctaattttttgtatttttagtagagacagagttttgctatgttggccaggctggttttgaactcctggcctcaagtgatccacccacctcagcctcccaaagtgctgggattacaggccactacacctggcacatttgagtattttttttttttttttttttttgagatggagtctcgctctgtcatctaggctggagtgcagtggtgtgatctcagctcactgcagcctctgtctcccgggctcaagcgattctcttgcctcagcctcctgagtagctaggactacaggtgcatgccaacacgcccggctaatttttttaaaaaatatttttagtagagacagggtttcaccattttggccaggatggtctcgatctcctgacctcatgatccacccgcctcggccttccaaagtgctgggattacaggcatgagccaccgtgcctggcctcatttgagtatttttataatgtctcttttaaagtctttgtcagataattccactgtacatgttattcagtgtttggtgtccactgagttgtcatttgccagacaagtggagatttttgcagctcatccttgtattctcagtagttccgatatgtaccctcgacatgtgaatgttatcttatgagactctgttttatttgtatccaacagaagatgtttattatttatttggctttctgtgaactgaggtcttaatatcagctcattttaaaagtctttgcagtggtattcggatctatcctgtgtgtgcctatgagattgggtgcagtgtatcctgttagctccattctcagggcgtttgaatgtgaattaggaccagcgcaatgaatgctcaagttggggttgggcgttagaattcataaaagtctttatatgctcagattctgcagctccatcctcttcatgattgtgatcgtaaggacagtggaattttgcagttgtctataccttatcttgaagtagaactaaattgttacatttgaagaatgtacttcataaatttacaaaaataaaaaaataggttaatgttattaaaacaaaaaggcacaca

SEQ ID NO: 298429 - DNA, 2675 bp, Homo sapiens
  misc_feature (1911)..(1911): n is a, c, g, or t
ctggctgtgtccacattgaacgtgggcataatacaaagagaagaaggagagatgtcaagacacatttggctcaagggagtgtgttatctctattatttataaatgtggataaaaatatcttcattcaaaatgtcttctatttcttgatagtctagatccgcccagtctaagagaactttctgtgatgacgggagtgttccattctctgctacacagtgttatagccgtgagtgatatgtagctgttgagcacttgaaatatggatagtgcaactgagaaactaaagtttacctaagtttaattcatacaaatttaaatagcatatccgggtagcggctactctacgggacagtgcagctctagttttcaataacatcgtcttcatcttcatcaactgattcttgatgtttttcatctttttgtaacatggggatcccaacctccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggagtgaggatgtggcctggatgctgcccaatcttgcctagaactggctgcacctgcttgtgccttaacccttggttaccctaaatccctgttatccagactcattgggactgctctagatcttcactatccaatacgggttactgtggcaacgccaacctttgaatccccctcctgcgcgctgagcggctcgtaaccatggagaccgaagcaggtttcccgcgtccgcctcctcacacagagactgcagccccggcgcccagaccctttggacaaggagatccaagcgggccccacaatgctcagcgggtaaagagctcctccccactcctctcccgccagcagacgaaggaaacaccccgcagcctgcacatgctcagatggagctctgggcccgcgggttctactgcgcaggccctcacactcagcaaagggacttggacgcgaaagccctggtggcgctcagccggntgggagttgtagctttctggctgctacagcaggagatacaggtggccaatgggtgagctggctggaggtaggaacaaggttaaggaagctgggatcttcgtgcagactggatcgtcactatagcaacaatgaaacatcgggaagggctagttctgctaggcagtctgccattttcattctttcatctttttttttaactcaaagcttactttgcaacaggcactgttctaggcactggggatacaatggaaaacaaaatagagcttctattttggcgggagatcgacttaataactgtgaacacgtgtcactggaaaaagcagtatgttaataagtaactgggctgctttgggaaaaatggaaatgcaggcaatgttagaacactggtacacacactaattcattcatcctcacaaagccctatagacaggtactattatgaccccctcaactgtaacataggctggaaggtcacatgacaaggaagtagtggagctgggatttgaacccaggcagtctggcttcatacttgataagcttaatcacaatgccaaactggtaaatagctgtgtggcataatttcaggtagtgataagtgctgtgaaggataaagcaaagaaaggggcagggatggctctttggagagactacttagggatggctttcaggaagaggtggcatttgagcaggggcccgagggattgatgtgacttgtgataaaagaaaaacttcagacgaattaaatttaaagaagtttaattggc

SEQ ID NO: 298430 - DNA, 3095 bp, Homo sapiens
  misc_feature (1911)..(1911): n is a, c, g, or t
ctggctgtgtccacattgaacgtgggcataatacaaagagaagaaggagagatgtcaagacacatttggctcaagggagtgtgttatctctattatttataaatgtggataaaaatatcttcattcaaaatgtcttctatttcttgatagtctagatccgcccagtctaagagaactttctgtgatgacgggagtgttccattctctgctacacagtgttatagccgtgagtgatatgtagctgttgagcacttgaaatatggatagtgcaactgagaaactaaagtttacctaagtttaattcatacaaatttaaatagcatatccgggtagcggctactctacgggacagtgcagctctagttttcaataacatcgtcttcatcttcatcaactgattcttgatgtttttcatctttttgtaacatggggatcccaacctccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaaggagttgaaattgtcctacaggagccctggagaaattcagcacttctcaaaattctatgctgggcagatgaaggaacccattcaacttgagattactgaaaaaagacatgggactttggtgtgggatactgaggtgaagccagtggatctccagcttgtagctgcatcagcccctcctcctttctcaggagtgaggatgtggcctggatgctgcccaatcttgcctagaactggctgcacctgcttgtgccttaacccttggttaccctaaatccctgttatccagactcattgggactgctctagatcttcactatccaatacgggttactgtggcaacgccaacctttgaatccccctcctgcgcgctgagcggctcgtaaccatggagaccgaagcaggtttcccgcgtccgcctcctcacacagagactgcagccccggcgcccagaccctttggacaaggagatccaagcgggccccacaatgctcagcgggtaaagagctcctccccactcctctcccgccagcagacgaaggaaacaccccgcagcctgcacatgctcagatggagctctgggcccgcgggttctactgcgcaggccctcacactcagcaaagggacttggacgcgaaagccctggtggcgctcagccggntgggagttgtagctttctggctgctacagcaggagatacaggtggccaatgggtgagctggctggaggtaggaacaaggttaaggaagctgggatcttcgtgcagactggatcgtcactatagcaacaatgaaacatcgggaagggctagttctgctaggcagtctgccattttcattctttcatctttttttttaactcaaagcttactttgcaacaggcactgttctaggcactggggatacaatggaaaacaaaatagagcttctattttggcgggagatcgacttaataactgtgaacacgtgtcactggaaaaagcagtatgttaataagtaactgggctgctttgggaaaaatggaaatgcaggcaatgttagaacactggtacacacactaattcattcatcctcacaaagccctatagacaggtactattatgaccccctcaactgtaacataggctggaaggtcacatgacaaggaagtagtggagctgggatttgaacccaggcagtctggcttcatacttgataagcttaatcacaatgccaaactggtaaatagctgtgtggcataatttcaggtagtgataagtgctgtgaaggataaagcaaagaaaggggcagggatggctctttggagagactacttagggatggctttcaggaagaggtggcatttgagcaggggcccgagggattgatgtgacttgtgataaaagaaaaacttcagacgaattaaatttaaagaagtttaattggctaggcactgtggttcatgcctgtaatcccagcactttgggaggccgaggagggcggatggcttcaagtcaggagcttgagaccagcctggtcaacatggcaaaaccctgtctctactacaaatacaaaaattagctaggcatggtggtgggcacctgtagtcccagctactcgggaggctgaggcacaagaattgcttgaacgcagaaggtggaggttgtagtgagctgagatcgcaccactgtgctccagcctgtgcaacagagcgagactccatctctaaataaataaataaatagagtttaattgagcaatgaaggatccacgaatcaggtagcctcgggccagagtaggctgaaactccagcacagccatgtggtggaagatttatggacagaaaaaggaaagtgacatacagaaa

SEQ ID NO: 298431 - DNA, 873 bp, Homo sapiens
aaaagaagttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgagaaggagggctgtctgagattcgagggaaacaagctctcaggacttccggtcgccatgatggctgtgggcggtaaacgcggttagtgcaagcatctgggccatcttcaatggtaaaaaagatacagtaaagacataaataccacatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacgtaagggacatctatttgttgggaaaaaattaaagatttggaattttgctccattggtttatgtacattcataagaagcaaagacatgcaggttatttgcataaaaattagtatatatgttacttttcttctttgttatcttaagtttttatttcaaaagagtttgtatcccaaagtgctgggattacaggcgtgagtcgctgcacccagccgataatacttcctgtaacaatagcgatatgatttggatgtttgtcccttccaaatctcatgctgaaatgtgatggagtgttggaggtggggcctggagg

SEQ ID NO: 298432 - DNA, 1406 bp, Homo sapiens
attctgcgcttagcggcgccctttttttccatttgtcaatgcggatgttgagttgatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacggtatacagggagctaccctgtgtttctgagaccctttgtgacatctcacattttttccaagaagatgatgagacagaggcagagccattattgttccgtgctgttcctgagtgtcaactatctgggggggacattcccaggtaagaaaagctattccgttggaaaactattggacgctgtgtctcaatatcacagaggaacatgagaattagaggaatttgggtgtttttcatcgaactcaggggagagtgaatgagcttatgcaatactggcaatgaatccagaaatttttgaaacaaaccttaagcaatgaggttttcttccatggaggtgtctagagaacctatacacaaaaaggcaatgagcaatgcaatcgaagaccagtgggttattggttaagctgttactcaatacataaaaccaacctaattctctaggaaactggctgatgcatgaggctgaaggcacagtggggtctgaggtttaacaccggggaggggagaatgcgtctatttgtagggtatgccaatttccaagggttgaatatccccatcatggcagatttcaaactaccaacgtgaagcccctgatgagggagttgaaagaacacatgcagaagtctgtcatcctgctttcaccacacagatacaagagacataaataacctcaagggcatagactgctgaaaagtgtagaaaaatgactggaaattggtatgttttaatatgtattacttttgtttttaatatgatttatttaaatgttagcttgtatcatttaatttagactaatggttgtgttgaacaacttggttgcaaaagccctgaaaatggaaccgtcagctctcatgatctgggatgcgctgtctgcagttcagcgctgggttcctcccactttctaaacccctcctcagcaggcagactccagcatgcacatgcaccaggaaagagaatataaaatggcatgtttactcttgctgctttgcctgtagctacccgaatccatagcaaaatgtgtagccgcagacagcaaccagtcttaggatgtcagcccaggggtctctccatgcttggcttgcccacagaatccttccgagaaaagcgctgtaaagcctttctcttcatcccacttc

SEQ ID NO: 298433 - DNA, 1503 bp, Homo sapiens
ctggctgtgtccacattgaacgtgggcataatacaaagagaagaaggagagatgtcaagacacatttggctcaagggagtgtgttatctctattatttataaatgtggataaaaatatcttcattcaaaatgtcttctatttcttgatagtctagatccgcccagtctaagagaactttctgtgatgacgggagtgttccattctctgctacacagtgttatagccgtgagtgatatgtagctgttgagcacttgaaatatggatagtgcaactgagaaactaaagtttacctaagtttaattcatacaaatttaaatagcatatccgggtagcggctactctacgggacagtgcagctctagttttcaataacatcgtcttcatcttcatcaactgattcttgatgtttttcatctttttgtaacatggggatcccaacctccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtgaggtggacgtctcctggtttctcgttgcccattttaagaatgaagggatggtcctggagcatccagcccgggtggagcctttctatgctgtcctggaaagccccagcttctctctgatgggcatcctgctgcggatcgccagtgggactcgcctctccatccccatcacttccaacacattgatctattatcacccccaccccgaagatattaagttccacttgtaccttgtccccagcgacgccttgctaacaaaggcgatagatgatgaggaagatcgcttccatggtgtgcgcctgcagacttcgcccccaatggaacccctgaactttggttccagttatattgtgtctaattctgctaacctgaaagtaatgcccaagtggatctccagcttgtagctgcatcagcccctcctcctttctcaggtaagtgaaatgtttacattaaagccaagggtatgtatgagacatcaaggggtctttgagtgacagtggaaggtatccaagtgacatggcaccagaacgttactggcagcaaatccgtataggtctgcagcaacctcaattcttgcctccttagaagacagaatttgactgaggggcataaggcagaaggagagaccgaggcaa

SEQ ID NO: 298434 - DNA, 762 bp, Homo sapiens
aaaagaagttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgggtaaaaaagatacagtaaagacataaataccacatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacgtaagggacatctatttgttgggaaaaaattaaagatttggaattttgctccattggtttatgtacattcataagaagcaaagacatgcaggttatttgcataaaaattagtatatatgttacttttcttctttgttatcttaagtttttatttcaaaagagtttgtatcccaaagtgctgggattacaggcgtgagtcgctgcacccagccgataatacttcctgtaacaatagcgatatgatttggatgtttgtcccttccaaatctcatgctgaaatgtgatggagtgttggaggtggggcctggagg

SEQ ID NO: 298435 - DNA, 916 bp, Homo sapiens
ctggctgtgtccacattgaacgtgggcataatacaaagagaagaaggagagatgtcaagacacatttggctcaagggagtgtgttatctctattatttataaatgtggataaaaatatcttcattcaaaatgtcttctatttcttgatagtctagatccgcccagtctaagagaactttctgtgatgacgggagtgttccattctctgctacacagtgttatagccgtgagtgatatgtagctgttgagcacttgaaatatggatagtgcaactgagaaactaaagtttacctaagtttaattcatacaaatttaaatagcatatccgggtagcggctactctacgggacagtgcagctctagttttcaataacatcgtcttcatcttcatcaactgattcttgatgtttttcatctttttgtaacatggggatcccaacctccagtgtatcagaagagcaggaatcttcagagggacaagattcaggagacatttgctcagaagagaatcaaatagtttcctcttatgcttctaaagtctgttttgagatcgaagaagattataaaaatcgtcagtttctggggcctgaaggaaatgtggatgttgagttgattgataagagcacaaacagatacagcgtttggttccccactgctggctggtatctgtggtcagccacaggcctcggcttcctggtaagggatgaggtcacagtgacgattgcgtttggttcctggagtcagcacctggccctggacctgcagcaccatgaacagtggctggtgggcggccccttgtttgatgtcactgcagagccagaggaggctgtcgccgaaatccacctcccccacttcatctccctccaaggtaatgtggggtgagcggaggctgtgggggccgctggggtgcgtgccg

SEQ ID NO: 298436 - DNA, 1124 bp, Homo sapiens
aaaagaagttgagaaccagagaaaccgacctaaggggattctcccatttggcccgtcctaccctaaagtcaccacctgctgcttttctggagcgcttaccagtgaccaagaggaacagaacacagagcagcctggcagtgtccaagcaacaagcctccgctcctccttcctgcaccctggggctcctgaaactcacatgagaaggagggctgtctgagattcgagggaaacaagctctcaggacttccggtcgccatgatggctgtgggcggtaaacgcggttagtgcaagcatctgggccatcttcaatggtaaaaaagatacagtaaagacataaataccacatttgacaaatggaaaaaaaggagtgtccagaaaagagtagcagcagtgaggaagagctgccgagacgggtatacagggagctaccctgtgtttctgagaccctttgtgacatctcacattttttccaagaagatgatgagacagaggcagagccattattgttccgtgctgttcctgagtgtcaactatctgggggggacattcccagatttcaaactaccaacgtgaagcccctgatgagggagttgaaagaacacatgcagaagtctgtcatcctgctttcaccacacagatacaagagacataaataacctcaagggcatagactgctgaaaagtgtagaaaaatgactggaaattggtatgttttaatatgtattacttttgtttttaatatgatttatttaaatgttagcttgtatcatttaatttagactaatggttgtgttgaacaacttggttgcaaaagccctgaaaatggaaccgtcagctctcatgatctgggatgcgctgtctgcagttcagcgctgggttcctcccactttctaaacccctcctcagcaggcagactccagcatgcacatgcaccaggaaagagaatataaaatggcatgtttactcttgctgctttgcctgtagctacccgaatccatagcaaaatgtgtagccgcagacagcaaccagtcttaggatgtcagcccaggggtctctccatgcttggcttgcccacagaatccttccgagaaaagcgctgtaaagcctttctcttcatcccacttc

SEQ ID NO: 298437 - DNA, 581 bp, Homo sapiens
aagcggcagcctataatttccatatagtcaaatagtaggatataagagtatgatttgacaaatggaaaaaaaggagtgtccagaaaagagtagcagcagtgaggaagagctgccgagacgggacagtggatccagtaggaacatagatgcatccaaactcattagactacaaggatcacggaaactgttggttgacaatagcatacgggaactgcaatacacaaaaactggaattttttttcaggctgaggcctgtgtgacaaatgatacgtaagggacatctatttgttgggaaaaaattaaagatttggaattttgctccattggtttatgtacattcataagaagcaaagacatgcaggttatttgcataaaaattagtatatatgttacttttcttctttgttatcttaagtttttatttcaaaagagtttgtatcccaaagtgctgggattacaggcgtgagtcgctgcacccagccgataatacttcctgtaacaatagcgatatgatttggatgtttgtcccttccaaatctcatgctgaaatgtgatggagtgttggaggtggggcctggagg

SEQ ID NO: 298438 - DNA, 294 bp, Homo sapiens
cagcgacgccttgctaacaaaggtaagctgagtgatttaggagaccagagaagatgacgattatatttccaggttatccccttggcccctccagttcctcgtggaacagaaagggcaaggcatggttttcatggacagaagcaggagtcacccttcctgaggttcatccaaggtgctgactctggagctatgtgcttccctaaccatcttcagtagtgattcagtgctactgaaaaaggaaattcccttttctggctctcaagaaggagaaagttagtgattttgggggaccag

SEQ ID NO: 298439 - DNA, 1479 bp, Homo sapiens
tagtgataaggctcataacaattagagaaggcttcttattggtcttacacagaaagatacatcaaaagcagcatgactcaaaatgatttggaaaaggttaaagttagtgctctgctgaagtgcctttgatatagacttgcattattagaaggatataacatcttttttaagtgtgcattttctttcagttaaccaaattaaacagatgtgcagttttattaaaaatatagacctagtgtttcatgttggaacaataaatattgcatgtgagtagtatttcttgttttttgaatacagtatatattgataaattgtttatgttggaatgaagttagaaactatatagcaaaacattatattttaagtgtttatttttcccacctttaaataaaaatgtttcatctcagcttggtaatgaaatacacatattggtataagggtataccattcaggtatgccacttattttattcatttttgtgtaagggaaatgagatgatgtatcccaagggcttttctagaactacttgtttgctttcagaataaaaccttattattttttacactgcacatgctgttctcaattggtaattataggcaatttatcttttctaatgatcaaaagagtgtgacttctcatttgtgagtagttcacaaatttcctgttaaaaagctgaaaccatctactttttcttaacccaagtgataataaacaatattcacaactttcttaaatttttaaattgaaaaccaaggttttttcaaatataaacctagatgattttggtcacaaattgttaacatttgtcgatcctttgtatatactttggatatatattaaaggcaaaactatctcttgactaactgatggattcatttactaaagcacagctgtatgtatttttgaatacatattatgatcttgagactttataaatcaatttttatgactttatgcagttgtatagggattatgccctttcagttctatagggattatgcccttttataatacataatataccacagagattacaaatgttgaggaatgaaagcacttctttgctttggcaatcattttcagaccactatgtgtttgaatcctctggtatcaatacgtattatagggttttagagatctgtgggtcaaatgatgtccctcaaaacttcctaaaaaggtgaagctcaaagtcacacattcatttataaggcgcatgagtttctcattttcccatgtacgagcattgtaaaggaattcagctgtattaatttctatttcagatctagaattgacattttgccttcttgtttccaggtgtttctattttttgtattctttcagagaaatctcatatttcggtgtatttattgctgttactactatatttactgctgaaaactgtaacaacctgaagatttgtaaaatgttaaacatagttcattaaaaataataaaataaatctaaaatgtacttggagca

SEQ ID NO: 298440 - DNA, 789 bp, Homo sapiens
gcgtggtcgcggccgaggtacgcgggattcacaactttcttaaatttttaaattgaaaaccaaggttttttcaaatataaacctagatgattttggtcacaaattgttaacatttgtcgatcctttgtatatactttggatatatattaaaggcaaaactatctcttgactaactgatggattcatttactaaagcacagctgtatgtatttttgaatacatattatgatcttgagactttataaatcaatttttatgactttatgcagttgtatagggattatgccctttcagttctatagggattatgcccttttataatacataatataccacagagattacaaatgttgaggaatgaaagcacttctttgctttggcaatcattttcagaccactatgtgtttgaatcctctggtatcaatacgtattatagggttttagagatctgtgggtcaaatgatgtccctcaaaacttcctaaaaaggtgaagctcaaagtcacacattcatttataaggcgcatgagtttctcattttcccatgtacgagcattgtaaaggaattcagctgtattaatttctatttcagatctagaattgacattttgccttcttgtttccaggtgtttctattttttgtattctttcagagaaatctcatatttcggtgtatttattgctgttactactatatttactgctgaaaactgtaacaacctgaagatttgtaaaatgttaaacatagttcattaaaaataataaaataaatctaaaatgtacttggagca

SEQ ID NO: 298441 - DNA, 751 bp, Homo sapiens
gcgtggtcgcggccgaggtacgcggggttttttcaaatataaacctagatgattttggtcacaaattgttaacatttgtcgatcctttgtatatactttggatatatattaaaggcaaaactatctcttgactaactgatggattcatttactaaagcacagctgtatgtatttttgaatacatattatgatcttgagactttataaatcaatttttatgactttatgcagttgtatagggattatgccctttcagttctatagggattatgcccttttataatacataatataccacagagattacaaatgttgaggaatgaaagcacttctttgctttggcaatcattttcagaccactatgtgtttgaatcctctggtatcaatacgtattatagggttttagagatctgtgggtcaaatgatgtccctcaaaacttcctaaaaaggtgaagctcaaagtcacacattcatttataaggcgcatgagtttctcattttcccatgtacgagcattgtaaaggaattcagctgtattaatttctatttcagatctagaattgacattttgccttcttgtttccaggtgtttctattttttgtattctttcagagaaatctcatatttcggtgtatttattgctgttactactatatttactgctgaaaactgtaacaacctgaagatttgtaaaatgttaaacatagttcattaaaaataataaaataaatctaaaatgtacttggagca

SEQ ID NO: 298442 - DNA, 219 bp, Homo sapiens
  misc_feature (39)..(40): n is a, c, g, or t
gaggtcgatctcaggatttactcttcactgtgttgagcnngaaagccaggtggctgctctgtcccctacatggggctgatgaagacacccagcacccctcaggtccttctccacccctaggttgaaagatctgttctaccgctccagcaacctgcagtacttcaagcggctcattcagatcccccagctgcctgaggtaagcatgcccaaccacacacc

SEQ ID NO: 298443 - DNA, 7962 bp, Homo sapiens
cacggcttggtcttaggtcctgtgtgactccagggaagtccagagaacagcctgttctcagatgatgttccctaacccagagccccctccagagactgtcagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaaagtgacgtgaacaactttttccagttaacagtggagatgtttgactacctggagtgtgaactcaacctcttccaaacagtattcaactccctggacatgtcccgctctgtgtccgtgacggcagcagggcagtgccgcctcgccccgctgatccaggtcatcttggactgcagccacctttatgactacactgtcaagcttctcttcaaactccactcctgcctcccagctgacaccctgcaaggccaccgggaccgcttcatggagcagtttacaaagttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaaggaaagctcaagccaatgaacagcgatatagcaagctaaaggagaagtacagcgagctggttcagaaccacgctgacctgctgcggaagaatgcagaggtgaccaaacaggtgtccatggccagacaagcccaggtagatttggaacgagagaaaaaagagctggaggattcgttggagcgcatcagtgaccagggccagcggaagactcaagaacagctggaagttctagagagcttgaagcaggaacttgccacaagccaacgggagcttcaggttctgcaaggcagcctggaaacttctgcccagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggaatctatgtgccagcttgccaaagaccaacgaaaaatgcttctggtggggtccaggaaggctgcggagcaggtgatacaagacgccctgaaccagcttgaagaacctcctctcatcagctgcgctgggtctgcagatcacctcctctccacggtcacatccatttccagctgcatcgagcaactggagaaaagctggagccagtatctggcctgcccagaagacatcagtggacttctccattccataaccctgctggcccacttgaccagcgacgccattgctcatggtgccaccacctgcctcagagccccacctgagcctgccgactcactgaccgaggcctgtaagcagtatggcagggaaaccctcgcctacctggcctccctggaggaagagggaagccttgagaatgccgacagcacagccatgaggaactgcctgagcaagatcaaggccatcggcgaggagctcctgcccaggggactggacatcaagcaggaggagctgggggacctggtggacaaggagatggcggccacttcagctgctattgaaactgccacggccagaatagaggagatgctcagcaaatcccgagcaggagacacaggagtcaaattggaggtgaatgaaaggatccttggttgctgtaccagcctcatgcaagctattcaggtgctcatcgtggcctctaaggacctccagagagagattgtggagagcggcaggggtacagcatcccctaaagagttttatgccaagaactctcgatggacagaaggacttatctcagcctccaaggctgtgggctggggagccactgtcatggtggatgcagctgatctggtggtacaaggcagagggaaatttgaggagctaatggtgtgttctcatgaaattgctgctagcacagcccagcttgtggctgcatccaaggtgaaagctgataaggacagccccaacctagcccagctgcagcaggcctctcggggagtgaaccaggccactgccggcgttgtggcctcaaccatttccggcaaatcacagatcgaagagacagacaacatggacttctcaagcatgacgctgacacagatcaaacgccaagagatggattctcaggttagggtgctagagctagaaaatgaattgcagaaggagcgtcaaaaactgggagagcttcggaaaaagcactacgagcttgctggtgttgctgagggctgggaagaaggaacagaggcatctccacctacactgcaagaagtggtaaccgaaaaagaatagagccaaaccaacaccccatatgtcagtgtaaatccttgttacctatctcgtgtgtgttatttccccagccacaggccaaatccttggagtcccaggggcagccacaccactgccattacccagtgccgaggacatgcatgacacttccaaagactccctccatagcgacaccctttctgtttggacccatggtcatctctgttcttttcccgcctccctagttagcatccaggctggccagtgctgcccatgagcaagcctaggtacgaagaggggtggtggggggcagggccaatcaacagagaggaccaacatccagtcctgctgactatttgacccccacaacaatgggtatccttaatagaggagctgcttgttgtttgttgacagcttggaaagggaagatcttatgccttttcttttctgttttcttctcagtcttttcagtttcatcatttgcacaaacttgtgagcatcagagggctgatggattccaaaccaggacactaccctgagatctgcacagtcagaaggacggcaggagtgtcctggctgtgaatgccaaagccattctccccctctttgggcagtgccatggatttccactgcttcttatggtggttgattgggttttttggttttgttttttttttttaagtttcactcacatagccaactctcccaaagggcacacccctggggctgagtctccagggccccccaactgtggtagctccagcgatggtgctgcccaggcctctcggtgctccatctccgcctccacactgaccaagtgctggcccacccagtccatgctccagggtcaggcggagctgctgagtgacagctttcctcaaaaagcagaaggagagtgagtgcctttccctcctaaagctgaatcccggcggaaagcctctgtccgcctttacaagggagaagacaacagaaagagggacaagagggttcacacagcccagttcccgtgacgaggctcaaaaacttgatcacatgcttgaatggagctggtgagatcaacaacactacttccctgccggaatgaactgtccgtgaatggtctctgtcaagcgggccgtctcccttggcccagagacggagtgtgggagtgattcccaactcctttctgcagacgtctgccttggcatcctcttgaataggaagatcgttccactttctacgcaattgacaaacccggaagatcagatgcaattgctcccatcagggaagaaccctatacttggtttgctacccttagtatttattactaacctcccttaagcagcaacagcctacaaagagatgcttggagcaatcagaacttcaggtgtgactctagcaaggctcatctttctgcccggctacatcagccttcaagaatcagaagaaaggccaaggtgctggactgttactgacttggatcccaaagcaaggagatcatttggagctcttgggtcagagaaaatgagaaaggacagagccagcggctccaactcctttcagccacatgccccaggctctcgctgccctgtggacaggatgaggacagagggcacatgaacagcttgccagggatgggcagcccaacagcacttttcctcttctagatggaccccagcatttaagtgaccttctgatcttggaaaaacagcgtcttccttctttatctatagcaactcattggtggtagccatcaagcacttcccaggatctgctccaacagaatattgctaggttttgctacatgacgggttgtgagacttctgtttgatcactgtgaaccaacccccatctccctagcccaccccgctccccaactccctctctgtgcattttctaagtgggacattcaaaaaactctctcccaggacctcggatgaccatactcagacgtgtgacctccatactgggctaaggaagtatcagcactagaaattgggcagtcttaatgttgaatgctgctttctgcttagtatttttttgattcaaggctcagaaggaatggtgcgtggcttccctgtcccagttgtggcaactaaaccaatcggtgtgttcttgatgcgggtcaacatttccaaaagtggctagtcctcacttctagatctcagccattctaactcatatgttcccaattaccaaggggtggccgggcacagtggctcacgcctgtaatcccagcactttgagaggctgaggtggtaggatcacctgaggtcaggagttcaagaccagcctgtccaacatggtgaaacccccatctctactaaaaataccaaaaattagccgagcgtagtgacgggtgcccgtaatcccagctactcaggaggctgagacaggagaatcacctgaaccccagaggcagaggttgcagtgagctgagatcacgccattgtactccagcctgggcaacaagagcaaaactccgtctcaaaaaaaaaaaaaaattacaaatggggcaaacagtctagtgtaatggatcaaattaagattctctgcccagccgggcacagtggcgcatgcctgtaatcccagaactttgggaggccaagacgggatgattgcttgagctcaggagtttgagaccaggctgggcatcatagcaagacctcatctctactaaaattcaaaaacaaaattagccgggcatgatggtgcatgcctgtagtctcagctagttggggagctaaggtgggagaattgcttgagcttgggaagtcgaggctgcagtcagccctgattgtgccagtgcactccggcctgggtgacagagtgagaccctgtctcaaaaaaaaaaagattctgtgtcagagcccagcccaggagtttgaggctgcaatgagccatgatttcccactgcactccagcctgagtgacagagcgagactccatctctttaaaaacaaacaaaaaattatctgaatgatcctgtctctaaaaagaagccacagaaatgtttaaaaacttcatcgacttagcctgagtcataacggttaagaaagcacttaaacagaagcagaggctaattcagtgtcacatgaggaagtagctgtcagatgtcacataattactttcgtaatagctcagattagaatggctaccccattctctagacaaaatcaaattgtcctattgtgactcttctaaaaatgaagatgaagagctatttaatgacacaccttggattaaaacgggaatcacatcttaaagctaaaaatgaacctgcaagccttctaaatgagtcactgagcatcactagtgacaagtctcgggtgagcgtaaatgggtcatgacaagatgggacagcaacaaaatcatggcttaggatcgacaagaagttaaaaaacagctgcatctgttacttaagtttgtaagacagtgccctgagacctctagagaaaagatgtttgtttacataagagaaagaggccagacatggtgtctcacacgtttaatcccagcactttgggaggcaggggcgggtggatcacctgaggtcaggagttcaagactagcctggccaacatggtgaaaccccgtctctactaaaaatacaaaaattagccgggcatggtggcaggcgcctataatcccagctactggggaggctgaggcaggagaatcacttgaacccgggggacagaggttgtagtgagccaagatcgcaccactgcactccagcctgggtcacagagtgagactccatctcaaaaaaaaaaaagagagagagagagaaagaaatagaagagaagagccatcttggcagggttattttatatctgagcaaggagtttaaatgagactagtttagattgtctgctgatgcagccgtccatagcagtacccctaaaatcccaccagaatacgggtccctctaacccagtggctggaagaaccactgtctagagcaacttttcttggaactgtcccagctaccaagtcagacaccaaggtttatgccaccaggtaacacgggaatcacaggtacatgtcgctccggtcagattagttggctttggcccctcgaccctgtgcaggagctagttctcagcttgcagctggaagttccctcttagctccttagtctagaggggtctcctggctccatttgaccctggtctttaataaccggtcagcatcttgctaccttctaccacctttccaaatctctggaaatcctgccagggaaagcctccagttccaacattggctttccaagcaaactggctttgccctctctctgccatccttgtcctccagagactgcaccacctgtagcatagaaaaccaccaccacggacctgccagccatcggcgcagcaaaccagccagctgtttgctgccaaattccttcctctcccaggtccagaccaaatacaagatcagcaccacaccgtggtgttgtcaggagccaaagcaacaggaaacaattcaatgctgttgggttcgattctgagagtagatttttccagacatgtctttcaggtgaccctcaactacctcaggtttgaaggccctaaatgaaactgattaccactcatagggacaaaccgagggggttcggttacatcttggtgataatgcagttgtctcaaacttataacagactctttcacatttcagtttgcagggatagggttgggtttgtttttcttctgtttttaacctttcccctgggtttccattagggtagttccttgaaatgaatttcatttttcactgagtgcctaccttcccagggcaggtggccactggcttctgtttccctccaacaatacttttattatggtattaagacctttctttgtataatacattgcatctgtgttttcaatttttcaaataaatatttccgcctggca

SEQ ID NO: 298444 - DNA, 8118 bp, Homo sapiens
cacggcttggtcttaggtcctgtgtgactccagggaagtccagagaacagcctgttctcagatgatgttccctaacccagagccccctccagagactgtcagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaaagtgacgtgaacaactttttccagttaacagtggagatgtttgactacctggagtgtgaactcaacctcttccaaacagtattcaactccctggacatgtcccgctctgtgtccgtgacggcagcagggcagtgccgcctcgccccgctgatccaggtcatcttggactgcagccacctttatgactacactgtcaagcttctcttcaaactccactcctgcctcccagctgacaccctgcaaggccaccgggaccgcttcatggagcagtttacaaagttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaaggaaagctcaagccaatgaacagcgatatagcaagctaaaggagaagtacagcgagctggttcagaaccacgctgacctgctgcggaagaatgcagaggtgaccaaacaggtgtccatggccagacaagcccaggtagatttggaacgagagaaaaaagagctggaggattcgttggagcgcatcagtgaccagggccagcggaagactcaagaacagctggaagttctagagagcttgaagcaggaacttgccacaagccaacgggagcttcaggttctgcaaggcagcctggaaacttctgcccagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggaatctatgtgccagcttgccaaagaccaacgaaaaatgcttctggtggggtccaggaaggctgcggagcaggtgatacaagacgccctgaaccagcttgaagaacctcctctcatcagctgcgctgggtctgcagatcacctcctctccacggtcacatccatttccagctgcatcgagcaactggagaaaagctggagccagtatctggcctgcccagaagacatcagtggacttctccattccataaccctgctggcccacttgaccagcgacgccattgctcatggtgccaccacctgcctcagagccccacctgagcctgccgactcactgaccgaggcctgtaagcagtatggcagggaaaccctcgcctacctggcctccctggaggaagagggaagccttgagaatgccgacagcacagccatgaggaactgcctgagcaagatcaaggccatcggcgaggagctcctgcccaggggactggacatcaagcaggaggagctgggggacctggtggacaaggagatggcggccacttcagctgctattgaaactgccacggccagaatagaggagatgctcagcaaatcccgagcaggagacacaggagtcaaattggaggtgaatgaaaggatccttggttgctgtaccagcctcatgcaagctattcaggtgctcatcgtggcctctaaggacctccagagagagattgtggagagcggcaggggtacagcatcccctaaagagttttatgccaagaactctcgatggacagaaggacttatctcagcctccaaggctgtgggctggggagccactgtcatggtggatgcagctgatctggtggtacaaggcagagggaaatttgaggagctaatggtgtgttctcatgaaattgctgctagcacagcccagcttgtggctgcatccaaggtgaaagctgataaggacagccccaacctagcccagctgcagcaggcctctcggggagtgaaccaggccactgccggcgttgtggcctcaaccatttccggcaaatcacagatcgaagagacagacaacatggacttctcaagcatgacgctgacacagatcaaacgccaagagatggattctcaggttagggtgctagagctagaaaatgaattgcagaaggagcgtcaaaaactgggagagcttcggaaaaagcactacgagcttgctggtgttgctgagggctgggaagaaggaacagaggcatctccacctacactgcaagaagtggtaaccgaaaaagaatagagccaaaccaacaccccatatgtcagtgtaaatccttgttacctatctcgtgtgtgttatttccccagccacaggccaaatccttggagtcccaggggcagccacaccactgccattacccagtgccgaggacatgcatgacacttccaaagactccctccatagcgacaccctttctgtttggacccatggtcatctctgttcttttcccgcctccctagttagcatccaggctggccagtgctgcccatgagcaagcctaggtacgaagaggggtggtggggggcagggccaatcaacagagaggaccaacatccagtcctgctgactatttgacccccacaacaatgggtatccttaatagaggagctgcttgttgtttgttgacagcttggaaagggaagatcttatgccttttcttttctgttttcttctcagtcttttcagtttcatcatttgcacaaacttgtgagcatcagagggctgatggattccaaaccaggacactaccctgagatctgcacagtcagaaggacggcaggagtgtcctggctgtgaatgccaaagccattctccccctctttgggcagtgccatggatttccactgcttcttatggtggttgattgggttttttggttttgttttttttttttaagtttcactcacatagccaactctcccaaagggcacacccctggggctgagtctccagggccccccaactgtggtagctccagcgatggtgctgcccaggcctctcggtgctccatctccgcctccacactgaccaagtgctggcccacccagtccatgctccagggtcaggcggagctgctgagtgacagctttcctcaaaaagcagaaggagagtgagtgcctttccctcctaaagctgaatcccggcggaaagcctctgtccgcctttacaagggagaagacaacagaaagagggacaagagggttcacacagcccagttcccgtgacgaggctcaaaaacttgatcacatgcttgaatggagctggtgagatcaacaacactacttccctgccggaatgaactgtccgtgaatggtctctgtcaagcgggccgtctcccttggcccagagacggagtgtgggagtgattcccaactcctttctgcagacgtctgccttggcatcctcttgaataggaagatcgttccactttctacgcaattgacaaacccggaagatcagatgcaattgctcccatcagggaagaaccctatacttggtttgctacccttagtatttattactaacctcccttaagcagcaacagcctacaaagagatgcttggagcaatcagaacttcaggtgtgactctagcaaggctcatctttctgcccggctacatcagccttcaagaatcagaagaaaggccaaggtgctggactgttactgacttggatcccaaagcaaggagatcatttggagctcttgggtcagagaaaatgagaaaggacagagccagcggctccaactcctttcagccacatgccccaggctctcgctgccctgtggacaggatgaggacagagggcacatgaacagcttgccagggatgggcagcccaacagcacttttcctcttctagatggaccccagcatttaagtgaccttctgatcttggaaaaacagcgtcttccttctttatctatagcaactcattggtggtagccatcaagcacttcccaggatctgctccaacagaatattgctaggttttgctacatgacgggttgtgagacttctgtttgatcactgtgaaccaacccccatctccctagcccaccccgctccccaactccctctctgtgcattttctaagtgggacattcaaaaaactctctcccaggacctcggatgaccatactcagacgtgtgacctccatactgggctaaggaagtatcagcactagaaattgggcagtcttaatgttgaatgctgctttctgcttagtatttttttgattcaaggctcagaaggaatggtgcgtggcttccctgtcccagttgtggcaactaaaccaatcggtgtgttcttgatgcgggtcaacatttccaaaagtggctagtcctcacttctagatctcagccattctaactcatatgttcccaattaccaaggggtggccgggcacagtggctcacgcctgtaatcccagcactttgagaggctgaggtggtaggatcacctgaggtcaggagttcaagaccagcctgtccaacatggtgaaacccccatctctactaaaaataccaaaaattagccgagcgtagtgacgggtgcccgtaatcccagctactcaggaggctgagacaggagaatcacctgaaccccagaggcagaggttgcagtgagctgagatcacgccattgtactccagcctgggcaacaagagcaaaactccgtctcaaaaaaaaaaaaaaattacaaatggggcaaacagtctagtgtaatggatcaaattaagattctctgcccagccgggcacagtggcgcatgcctgtaatcccagaactttgggaggccaagacgggatgattgcttgagctcaggagtttgagaccaggctgggcatcatagcaagacctcatctctactaaaattcaaaaacaaaattagccgggcatgatggtgcatgcctgtagtctcagctagttggggagctaaggtgggagaattgcttgagcttgggaagtcgaggctgcagtcagccctgattgtgccagtgcactccggcctgggtgacagagtgagaccctgtctcaaaaaaaaaaagattctgtgtcagagcccagcccaggagtttgaggctgcaatgagccatgatttcccactgcactccagcctgagtgacagagcgagactccatctctttaaaaacaaacaaaaaattatctgaatgatcctgtctctaaaaagaagccacagaaatgtttaaaaacttcatcgacttagcctgagtcataacggttaagaaagcacttaaacagaagcagaggctaattcagtgtcacatgaggaagtagctgtcagatgtcacataattactttcgtaatagctcagattagaatggctaccccattctctagacaaaatcaaattgtcctattgtgactcttctaaaaatgaagatgaagagctatttaatgacacaccttggattaaaacgggaatcacatcttaaagctaaaaatgaacctgcaagccttctaaatgagtcactgagcatcactagtgacaagtctcgggtgagcgtaaatgggtcatgacaagatgggacagcaacaaaatcatggcttaggatcgacaagaagttaaaaaacagctgcatctgttacttaagtttgtaagacagtgccctgagacctctagagaaaagatgtttgtttacataagagaaagaggccagacatggtgtctcacacgtttaatcccagcactttgggaggcaggggcgggtggatcacctgaggtcaggagttcaagactagcctggccaacatggtgaaaccccgtctctactaaaaatacaaaaattagccgggcatggtggcaggcgcctataatcccagctactggggaggctgaggcaggagaatcacttgaacccgggggacagaggttgtagtgagccaagatcgcaccactgcactccagcctgggtcacagagtgagactccatctcaaaaaaaaaaaagagagagagagagaaagaaatagaagagaagagccatcttggcagggttattttatatctgagcaaggagtttaaatgagactagtttagattgtctgctgatgcagccgtccatagcagtacccctaaaatcccaccagaatacgggtccctctaacccagtggctggaagaaccactgtctagagcaacttttcttggaactgtcccagctaccaagtcagacaccaaggtttatgccaccaggtaacacgggaatcacaggtacatgtcgctccggtcagattagttggctttggcccctcgaccctgtgcaggagctagttctcagcttgcagctggaagttccctcttagctccttagtctagaggggtctcctggctccatttgaccctggtctttaataaccggtcagcatcttgctaccttctaccacctttccaaatctctggaaatcctgccagggaaagcctccagttccaacattggctttccaagcaaactggctttgccctctctctgccatccttgtcctccagagactgcaccacctgtagcatagaaaaccaccaccacggacctgccagccatcggcgcagcaaaccagccagctgtttgctgccaaattccttcctctcccaggtccagaccaaatacaagatcagcaccacaccgtggtgttgtcaggagccaaagcaacaggaaacaattcaatgctgttgggttcgattctgagagtagatttttccagacatgtctttcaggtgaccctcaactacctcaggtttgaaggccctaaatgaaactgattaccactcatagggacaaaccgagggggttcggttacatcttggtgataatgcagttgtctcaaacttataacagactctttcacatttcagtttgcagggatagggttgggtttgtttttcttctgtttttaacctttcccctgggtttccattagggtagttccttgaaatgaatttcatttttcactgagtgcctaccttcccagggcaggtggccactggcttctgtttccctccaacaatacttttattatggtattaagacctttctttgtataatacattgcatctgtgttttcaatttttcaaataaatatttccgcctggcaatggagcgtggtggtgattgaccagccagcgtggctctgaggtataggctccagtgagaagcctgcatttgtatcctggggttcatggaatccacttagccccacacctctgggaatatatcttagaaatattagttttgagccgggtgtggtggc

SEQ ID NO: 298445 - DNA, 7909 bp, Homo sapiens
cacggcttggtcttaggtcctgtgtgactccagggaagtccagagaacagcctgttctcagatgatgttccctaacccagagccccctccagagactgtcagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaaagtgacgtgaacaactttttccagttaacagtggagatgtttgactacctggagtgtgaactcaacctcttccaaacagtattcaactccctggacatgtcccgctctgtgtccgtgacggcagcagggcagtgccgcctcgccccgctgatccaggtcatcttggactgcagccacctttatgactacactgtcaagcttctcttcaaactccactcctgcctcccagctgacaccctgcaaggccaccgggaccgcttcatggagcagtttacaaagttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaaggaaagctcaagccaatgaacagcgatatagcaagctaaaggagaagtacagcgagctggttcagaaccacgctgacctgctgcggaagaatgcagaggtgaccaaacaggtgtccatggccagacaagcccaggtagatttggaacgagagaaaaaagagctggaggattcgttggagcgcatcagtgaccagggccagcggaagactcaagaacagctggaagttctagagagcttgaagcaggaacttgccacaagccaacgggagcttcaggttctgcaaggcagcctggaaacttctgcccagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggaatctatgtgccagcttgccaaagaccaacgaaaaatgcttctggtggggtccaggaaggctgcggagcaggtgatacaagacgccctgaaccagcttgaagaacctcctctcatcagctgcgctgggtctgcagatcacctcctctccacggtcacatccatttccagctgcatcgagcaactggagaaaagctggagccagtatctggcctgcccagaagacatcagtggacttctccattccataaccctgctggcccacttgaccagcgacgccattgctcatggtgccaccacctgcctcagagccccacctgagcctgccgactcactgaccgaggcctgtaagcagtatggcagggaaaccctcgcctacctggcctccctggaggaagagggaagccttgagaatgccgacagcacagccatgaggaactgcctgagcaagatcaaggccatcggcgaggagctcctgcccaggggactggacatcaagcaggaggagctgggggacctggtggacaaggagatggcggccacttcagctgctattgaaactgccacggccagaatagaggagatgctcagcaaatcccgagcaggagacacaggagtcaaattggaggtgaatgaaaggatccttggttgctgtaccagcctcatgcaagctattcaggtgctcatcgtggcctctaaggacctccagagagagattgtggagagcggcaggggtacagcatcccctaaagagttttatgccaagaactctcgatggacagaaggacttatctcagcctccaaggctgtgggctggggagccactgtcatggtggatgcagctgatctggtggtacaaggcagagggaaatttgaggagctaatggtgtgttctcatgaaattgctgctagcacagcccagcttgtggctgcatccaaggtgaaagctgataaggacagccccaacctagcccagctgcagcaggcctctcggggagtgaaccaggccactgccggcgttgtggcctcaaccatttccggcaaatcacagatcgaagagacagacaacatggacttctcaagcatgacgctgacacagatcaaacgccaagagatggattctcaggttagggtgctagagctagaaaatgaattgcagaaggagcgtcaaaaactgggagagcttcggaaaaagcactacgagcttgctggtgttgctgagggctgggaagaaggaacagaggcatctccacctacactgcaagaagtggtaaccgaaaaagaatagagccaaaccaacaccccatatgtcagtgtaaatccttgttacctatctcgtgtgtgttatttccccagccacaggccaaatccttggagtcccaggggcagccacaccactgccattacccagtgccgaggacatgcatgacacttccaaagactccctccatagcgacaccctttctgtttggacccatggtcatctctgttcttttcccgcctccctagttagcatccaggctggccagtgctgcccatgagcaagcctaggtacgaagaggggtggtggggggcagggccaatcaacagagaggaccaacatccagtcctgctgactatttgacccccacaacaatgggtatccttaatagaggagctgcttgttgtttgttgacagcttggaaagggaagatcttatgccttttcttttctgttttcttctcagtcttttcagtttcatcatttgcacaaacttgtgagcatcagagggctgatggattccaaaccaggacactaccctgagatctgcacagtcagaaggacggcaggagtgtcctggctgtgaatgccaaagccattctccccctctttgggcagtgccatggatttccactgcttcttatggtggttgattgggttttttggttttgttttttttttttaagtttcactcacatagccaactctcccaaagggcacacccctggggctgagtctccagggccccccaactgtggtagctccagcgatggtgctgcccaggcctctcggtgctccatctccgcctccacactgaccaagtgctggcccacccagtccatgctccagggtcaggcggagctgctgagtgacagctttcctcaaaaagcagaaggagagtgagtgcctttccctcctaaagctgaatcccggcggaaagcctctgtccgcctttacaagggagaagacaacagaaagagggacaagagggttcacacagcccagttcccgtgacgaggctcaaaaacttgatcacatgcttgaatggagctggtgagatcaacaacactacttccctgccggaatgaactgtccgtgaatggtctctgtcaagcgggccgtctcccttggcccagagacggagtgtgggagtgattcccaactcctttctgcagacgtctgccttggcatcctcttgaataggaagatcgttccactttctacgcaattgacaaacccggaagatcagatgcaattgctcccatcagggaagaaccctatacttggtttgctacccttagtatttattactaacctcccttaagcagcaacagcctacaaagagatgcttggagcaatcagaacttcaggtgtgactctagcaaggctcatctttctgcccggctacatcagccttcaagaatcagaagaaaggccaaggtgctggactgttactgacttggatcccaaagcaaggagatcatttggagctcttgggtcagagaaaatgagaaaggacagagccagcggctccaactcctttcagccacatgccccaggctctcgctgccctgtggacaggatgaggacagagggcacatgaacagcttgccagggatgggcagcccaacagcacttttcctcttctagatggaccccagcatttaagtgaccttctgatcttggaaaaacagcgtcttccttctttatctatagcaactcattggtggtagccatcaagcacttcccaggatctgctccaacagaatattgctaggttttgctacatgacgggttgtgagacttctgtttgatcactgtgaaccaacccccatctccctagcccaccccgctccccaactccctctctgtgcattttctaagtgggacattcaaaaaactctctcccaggacctcggatgaccatactcagacgtgtgacctccatactgggctaaggaagtatcagcactagaaattgggcagtcttaatgttgaatgctgctttctgcttagtatttttttgattcaaggctcagaaggaatggtgcgtggcttccctgtcccagttgtggcaactaaaccaatcggtgtgttcttgatgcgggtcaacatttccaaaagtggctagtcctcacttctagatctcagccattctaactcatatgttcccaattaccaaggggtggccgggcacagtggctcacgcctgtaatcccagcactttgagaggctgaggtggtaggatcacctgaggtcaggagttcaagaccagcctgtccaacatggtgaaacccccatctctactaaaaataccaaaaattagccgagcgtagtgacgggtgcccgtaatcccagctactcaggaggctgagacaggagaatcacctgaaccccagaggcagaggttgcagtgagctgagatcacgccattgtactccagcctgggcaacaagagcaaaactccgtctcaaaaaaaaaaaaaaattacaaatggggcaaacagtctagtgtaatggatcaaattaagattctctgcccagccgggcacagtggcgcatgcctgtaatcccagaactttgggaggccaagacgggatgattgcttgagctcaggagtttgagaccaggctgggcatcatagcaagacctcatctctactaaaattcaaaaacaaaattagccgggcatgatggtgcatgcctgtagtctcagctagttggggagctaaggtgggagaattgcttgagcttgggaagtcgaggctgcagtcagccctgattgtgccagtgcactccggcctgggtgacagagtgagaccctgtctcaaaaaaaaaaagattctgtgtcagagcccagcccaggagtttgaggctgcaatgagccatgatttcccactgcactccagcctgagtgacagagcgagactccatctctttaaaaacaaacaaaaaattatctgaatgatcctgtctctaaaaagaagccacagaaatgtttaaaaacttcatcgacttagcctgagtcataacggttaagaaagcacttaaacagaagcagaggctaattcagtgtcacatgaggaagtagctgtcagatgtcacataattactttcgtaatagctcagattagaatggctaccccattctctagacaaaatcaaattgtcctattgtgactcttctaaaaatgaagatgaagagctatttaatgacacaccttggattaaaacgggaatcacatcttaaagctaaaaatgaacctgcaagccttctaaatgagtcactgagcatcactagtgacaagtctcgggtgagcgtaaatgggtcatgacaagatgggacagcaacaaaatcatggcttaggatcgacaagaagttaaaaaacagctgcatctgttacttaagtttgtaagacagtgccctgagacctctagagaaaagatgtttgtttacataagagaaagaggccagacatggtgtctcacacgtttaatcccagcactttgggaggcaggggcgggtggatcacctgaggtcaggagttcaagactagcctggccaacatggtgaaaccccgtctctactaaaaatacaaaaattagccgggcatggtggcaggcgcctataatcccagctactggggaggctgaggcaggagaatcacttgaacccgggggacagaggttgtagtgagccaagatcgcaccactgcactccagcctgggtcacagagtgagactccatctcaaaaaaaaaaaagagagagagagagaaagaaatagaagagaagagccatcttggcagggttattttatatctgagcaaggagtttaaatgagactagtttagattgtctgctgatgcagccgtccatagcagtaccctgtctagagcaacttttcttggaactgtcccagctaccaagtcagacaccaaggtttatgccaccaggtaacacgggaatcacaggtacatgtcgctccggtcagattagttggctttggcccctcgaccctgtgcaggagctagttctcagcttgcagctggaagttccctcttagctccttagtctagaggggtctcctggctccatttgaccctggtctttaataaccggtcagcatcttgctaccttctaccacctttccaaatctctggaaatcctgccagggaaagcctccagttccaacattggctttccaagcaaactggctttgccctctctctgccatccttgtcctccagagactgcaccacctgtagcatagaaaaccaccaccacggacctgccagccatcggcgcagcaaaccagccagctgtttgctgccaaattccttcctctcccaggtccagaccaaatacaagatcagcaccacaccgtggtgttgtcaggagccaaagcaacaggaaacaattcaatgctgttgggttcgattctgagagtagatttttccagacatgtctttcaggtgaccctcaactacctcaggtttgaaggccctaaatgaaactgattaccactcatagggacaaaccgagggggttcggttacatcttggtgataatgcagttgtctcaaacttataacagactctttcacatttcagtttgcagggatagggttgggtttgtttttcttctgtttttaacctttcccctgggtttccattagggtagttccttgaaatgaatttcatttttcactgagtgcctaccttcccagggcaggtggccactggcttctgtttccctccaacaatacttttattatggtattaagacctttctttgtataatacattgcatctgtgttttcaatttttcaaataaatatttccgcctggca

SEQ ID NO: 298446 - DNA, 7904 bp, Homo sapiens
cacggcttggtcttaggtcctgtgtgactccagggaagtccagagaacagcctgttctcagatgatgttccctaacccagagccccctccagagactgtcagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaaagtgacgtgaacaactttttccagttaacagtggagatgtttgactacctggagtgtgaactcaacctcttccaaacagtattcaactccctggacatgtcccgctctgtgtccgtgacggcagcagggcagtgccgcctcgccccgctgatccaggtcatcttggactgcagccacctttatgactacactgtcaagcttctcttcaaactccactcctgcctcccagctgacaccctgcaaggccaccgggaccgcttcatggagcagtttacaaagttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaaggaaagctcaagccaatgaacagcgatatagcaagctaaaggagaagtacagcgagctggttcagaaccacgctgacctgctgcggaagaatgcagaggtgaccaaacaggtgtccatggccagacaagcccaggtagatttggaacgagagaaaaaagagctggaggattcgttggagcgcatcagtgaccagggccagcggaagactcaagaacagctggaagttctagagagcttgaagcaggaacttgccacaagccaacgggagcttcaggttctgcaaggcagcctggaaacttctgcccagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggaatctatgtgccagcttgccaaagaccaacgaaaaatgcttctggtggggtccaggaaggctgcggagcaggtgatacaagacgccctgaaccagcttgaagaacctcctctcatcagctgcgctgggtctgcagatcacctcctctccacggtcacatccatttccagctgcatcgagcaactggagaaaagctggagccagtatctggcctgcccagaagacatcagtggacttctccattccataaccctgctggcccacttgaccagcgacgccattgctcatggtgccaccacctgcctcagagccccacctgagcctgccgactcactgaccgaggcctgtaagcagtatggcagggaaaccctcgcctacctggcctccctggaggaagagggaagccttgagaatgccgacagcacagccatgaggaactgcctgagcaagatcaaggccatcggcgaggagctcctgcccaggggactggacatcaagcaggaggagctgggggacctggtggacaaggagatggcggccacttcagctgctattgaaactgccacggccagaatagaggagatgctcagcaaatcccgagcaggagacacaggagtcaaattggaggtgaatgaaaggatccttggttgctgtaccagcctcatgcaagctattcaggtgctcatcgtggcctctaaggacctccagagagagattgtggagagcggcaggggtacagcatcccctaaagagttttatgccaagaactctcgatggacagaaggacttatctcagcctccaaggctgtgggctggggagccactgtcatggtggatgcagctgatctggtggtacaaggcagagggaaatttgaggagctaatggtgtgttctcatgaaattgctgctagcacagcccagcttgtggctgcatccaaggtgaaagctgataaggacagccccaacctagcccagctgcagcaggcctctcggggagtgaaccaggccactgccggcgttgtggcctcaaccatttccggcaaatcacagatcgaagagacagacaacatggacttctcaagcatgacgctgacacagatcaaacgccaagagatggattctcaggttagggtgctagagctagaaaatgaattgcagaaggagcgtcaaaaactgggagagcttcggaaaaagcactacgagcttgctggtgttgctgagggctgggaagaaggaacagaggcatctccacctacactgcaagaagtggtaaccgaaaaagaatagagccaaaccaacaccccatatgtcagtgtaaatccttgttacctatctcgtgtgtgttatttccccagccacaggccaaatccttggagtcccaggggcagccacaccactgccattacccagtgccgaggacatgcatgacacttccaaagactccctccatagcgacaccctttctgtttggacccatggtcatctctgttcttttcccgcctccctagttagcatccaggctggccagtgctgcccatgagcaagcctaggtacgaagaggggtggtggggggcagggccaatcaacagagaggaccaacatccagtcctgctgactatttgacccccacaacaatgggtatccttaatagaggagctgcttgttgtttgttgacagcttggaaagggaagatcttatgccttttcttttctgttttcttctcagtcttttcagtttcatcatttgcacaaacttgtgagcatcagagggctgatggattccaaaccaggacactaccctgagatctgcacagtcagaaggacggcaggagtgtcctggctgtgaatgccaaagccattctccccctctttgggcagtgccatggatttccactgcttcttatggtggttgattgggttttttggttttgttttttttttttaagtttcactcacatagccaactctcccaaagggcacacccctggggctgagtctccagggccccccaactgtggtagctccagcgatggtgctgcccaggcctctcggtgctccatctccgcctccacactgaccaagtgctggcccacccagtccatgctccagggtcaggcggagctgctgagtgacagctttcctcaaaaagcagaaggagagtgagtgcctttccctcctaaagctgaatcccggcggaaagcctctgtccgcctttacaagggagaagacaacagaaagagggacaagagggttcacacagcccagttcccgtgacgaggctcaaaaacttgatcacatgcttgaatggagctggtgagatcaacaacactacttccctgccggaatgaactgtccgtgaatggtctctgtcaagcgggccgtctcccttggcccagagacggagtgtgggagtgattcccaactcctttctgcagacgtctgccttggcatcctcttgaataggaagatcgttccactttctacgcaattgacaaacccggaagatcagatgcaattgctcccatcagggaagaaccctatacttggtttgctacccttagtatttattactaacctcccttaagcagcaacagcctacaaagagatgcttggagcaatcagaacttcaggtgtgactctagcaaggctcatctttctgcccggctacatcagccttcaagaatcagaagaaaggccaaggtgctggactgttactgacttggatcccaaagcaaggagatcatttggagctcttgggtcagagaaaatgagaaaggacagagccagcggctccaactcctttcagccacatgccccaggctctcgctgccctgtggacaggatgaggacagagggcacatgaacagcttgccagggatgggcagcccaacagcacttttcctcttctagatggaccccagcatttaagtgaccttctgatcttggaaaaacagcgtcttccttctttatctatagcaactcattggtggtagccatcaagcacttcccaggatctgctccaacagaatattgctaggttttgctacatgacgggttgtgagacttctgtttgatcactgtgaaccaacccccatctccctagcccaccccgctccccaactccctctctgtgcattttctaagtgggacattcaaaaaactctctcccaggacctcggatgaccatactcagacgtgtgacctccatactgggctaaggaagtatcagcactagaaattgggcagtcttaatgttgaatgctgctttctgcttagtatttttttgattcaaggctcagaaggaatggtgcgtggcttccctgtcccagttgtggcaactaaaccaatcggtgtgttcttgatgcgggtcaacatttccaaaagtggctagtcctcacttctagatctcagccattctaactcatatgttcccaattaccaaggggtggccgggcacagtggctcacgcctgtaatcccagcactttgagaggctgaggtggtaggatcacctgaggtcaggagttcaagaccagcctgtccaacatggtgaaacccccatctctactaaaaataccaaaaattagccgagcgtagtgacgggtgcccgtaatcccagctactcaggaggctgagacaggagaatcacctgaaccccagaggcagaggttgcagtgagctgagatcacgccattgtactccagcctgggcaacaagagcaaaactccgtctcaaaaaaaaaaaaaaattacaaatggggcaaacagtctagtgtaatggatcaaattaagattctctgcccagccgggcacagtggcgcatgcctgtaatcccagaactttgggaggccaagacgggatgattgcttgagctcaggagtttgagaccaggctgggcatcatagcaagacctcatctctactaaaattcaaaaacaaaattagccgggcatgatggtgcatgcctgtagtctcagctagttggggagctaaggtgggagaattgcttgagcttgggaagtcgaggctgcagtcagccctgattgtgccagtgcactccggcctgggtgacagagtgagaccctgtctcaaaatttcccactgcactccagcctgagtgacagagcgagactccatctctttaaaaacaaacaaaaaattatctgaatgatcctgtctctaaaaagaagccacagaaatgtttaaaaacttcatcgacttagcctgagtcataacggttaagaaagcacttaaacagaagcagaggctaattcagtgtcacatgaggaagtagctgtcagatgtcacataattactttcgtaatagctcagattagaatggctaccccattctctagacaaaatcaaattgtcctattgtgactcttctaaaaatgaagatgaagagctatttaatgacacaccttggattaaaacgggaatcacatcttaaagctaaaaatgaacctgcaagccttctaaatgagtcactgagcatcactagtgacaagtctcgggtgagcgtaaatgggtcatgacaagatgggacagcaacaaaatcatggcttaggatcgacaagaagttaaaaaacagctgcatctgttacttaagtttgtaagacagtgccctgagacctctagagaaaagatgtttgtttacataagagaaagaggccagacatggtgtctcacacgtttaatcccagcactttgggaggcaggggcgggtggatcacctgaggtcaggagttcaagactagcctggccaacatggtgaaaccccgtctctactaaaaatacaaaaattagccgggcatggtggcaggcgcctataatcccagctactggggaggctgaggcaggagaatcacttgaacccgggggacagaggttgtagtgagccaagatcgcaccactgcactccagcctgggtcacagagtgagactccatctcaaaaaaaaaaaagagagagagagagaaagaaatagaagagaagagccatcttggcagggttattttatatctgagcaaggagtttaaatgagactagtttagattgtctgctgatgcagccgtccatagcagtacccctaaaatcccaccagaatacgggtccctctaacccagtggctggaagaaccactgtctagagcaacttttcttggaactgtcccagctaccaagtcagacaccaaggtttatgccaccaggtaacacgggaatcacaggtacatgtcgctccggtcagattagttggctttggcccctcgaccctgtgcaggagctagttctcagcttgcagctggaagttccctcttagctccttagtctagaggggtctcctggctccatttgaccctggtctttaataaccggtcagcatcttgctaccttctaccacctttccaaatctctggaaatcctgccagggaaagcctccagttccaacattggctttccaagcaaactggctttgccctctctctgccatccttgtcctccagagactgcaccacctgtagcatagaaaaccaccaccacggacctgccagccatcggcgcagcaaaccagccagctgtttgctgccaaattccttcctctcccaggtccagaccaaatacaagatcagcaccacaccgtggtgttgtcaggagccaaagcaacaggaaacaattcaatgctgttgggttcgattctgagagtagatttttccagacatgtctttcaggtgaccctcaactacctcaggtttgaaggccctaaatgaaactgattaccactcatagggacaaaccgagggggttcggttacatcttggtgataatgcagttgtctcaaacttataacagactctttcacatttcagtttgcagggatagggttgggtttgtttttcttctgtttttaacctttcccctgggtttccattagggtagttccttgaaatgaatttcatttttcactgagtgcctaccttcccagggcaggtggccactggcttctgtttccctccaacaatacttttattatggtattaagacctttctttgtataatacattgcatctgtgttttcaatttttcaaataaatatttccgcctggca

SEQ ID NO: 298447 - DNA, 7287 bp, Homo sapiens
agcgggcgtggggagggggcaggaaagccaggtggctgctctgtcccctacatggggctgatgaagacacccagcacccctcaggtccttctccacccctaggttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaaggaaagctcaagccaatgaacagcgatatagcaagctaaaggagaagtacagcgagctggttcagaaccacgctgacctgctgcggaagaatgcagaggtgaccaaacaggtgtccatggccagacaagcccaggtagatttggaacgagagaaaaaagagctggaggattcgttggagcgcatcagtgaccagggccagcggaagactcaagaacagctggaagttctagagagcttgaagcaggaacttgccacaagccaacgggagcttcaggttctgcaaggcagcctggaaacttctgcccagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggaatctatgtgccagcttgccaaagaccaacgaaaaatgcttctggtggggtccaggaaggctgcggagcaggtgatacaagacgccctgaaccagcttgaagaacctcctctcatcagctgcgctgggtctgcagatcacctcctctccacggtcacatccatttccagctgcatcgagcaactggagaaaagctggagccagtatctggcctgcccagaagacatcagtggacttctccattccataaccctgctggcccacttgaccagcgacgccattgctcatggtgccaccacctgcctcagagccccacctgagcctgccgactcactgaccgaggcctgtaagcagtatggcagggaaaccctcgcctacctggcctccctggaggaagagggaagccttgagaatgccgacagcacagccatgaggaactgcctgagcaagatcaaggccatcggcgaggagctcctgcccaggggactggacatcaagcaggaggagctgggggacctggtggacaaggagatggcggccacttcagctgctattgaaactgccacggccagaatagaggagatgctcagcaaatcccgagcaggagacacaggagtcaaattggaggtgaatgaaaggatccttggttgctgtaccagcctcatgcaagctattcaggtgctcatcgtggcctctaaggacctccagagagagattgtggagagcggcaggggtacagcatcccctaaagagttttatgccaagaactctcgatggacagaaggacttatctcagcctccaaggctgtgggctggggagccactgtcatggtggatgcagctgatctggtggtacaaggcagagggaaatttgaggagctaatggtgtgttctcatgaaattgctgctagcacagcccagcttgtggctgcatccaaggtgaaagctgataaggacagccccaacctagcccagctgcagcaggcctctcggggagtgaaccaggccactgccggcgttgtggcctcaaccatttccggcaaatcacagatcgaagagacagacaacatggacttctcaagcatgacgctgacacagatcaaacgccaagagatggattctcaggttagggtgctagagctagaaaatgaattgcagaaggagcgtcaaaaactgggagagcttcggaaaaagcactacgagcttgctggtgttgctgagggctgggaagaaggaacagaggcatctccacctacactgcaagaagtggtaaccgaaaaagaatagagccaaaccaacaccccatatgtcagtgtaaatccttgttacctatctcgtgtgtgttatttccccagccacaggccaaatccttggagtcccaggggcagccacaccactgccattacccagtgccgaggacatgcatgacacttccaaagactccctccatagcgacaccctttctgtttggacccatggtcatctctgttcttttcccgcctccctagttagcatccaggctggccagtgctgcccatgagcaagcctaggtacgaagaggggtggtggggggcagggccaatcaacagagaggaccaacatccagtcctgctgactatttgacccccacaacaatgggtatccttaatagaggagctgcttgttgtttgttgacagcttggaaagggaagatcttatgccttttcttttctgttttcttctcagtcttttcagtttcatcatttgcacaaacttgtgagcatcagagggctgatggattccaaaccaggacactaccctgagatctgcacagtcagaaggacggcaggagtgtcctggctgtgaatgccaaagccattctccccctctttgggcagtgccatggatttccactgcttcttatggtggttgattgggttttttggttttgttttttttttttaagtttcactcacatagccaactctcccaaagggcacacccctggggctgagtctccagggccccccaactgtggtagctccagcgatggtgctgcccaggcctctcggtgctccatctccgcctccacactgaccaagtgctggcccacccagtccatgctccagggtcaggcggagctgctgagtgacagctttcctcaaaaagcagaaggagagtgagtgcctttccctcctaaagctgaatcccggcggaaagcctctgtccgcctttacaagggagaagacaacagaaagagggacaagagggttcacacagcccagttcccgtgacgaggctcaaaaacttgatcacatgcttgaatggagctggtgagatcaacaacactacttccctgccggaatgaactgtccgtgaatggtctctgtcaagcgggccgtctcccttggcccagagacggagtgtgggagtgattcccaactcctttctgcagacgtctgccttggcatcctcttgaataggaagatcgttccactttctacgcaattgacaaacccggaagatcagatgcaattgctcccatcagggaagaaccctatacttggtttgctacccttagtatttattactaacctcccttaagcagcaacagcctacaaagagatgcttggagcaatcagaacttcaggtgtgactctagcaaggctcatctttctgcccggctacatcagccttcaagaatcagaagaaaggccaaggtgctggactgttactgacttggatcccaaagcaaggagatcatttggagctcttgggtcagagaaaatgagaaaggacagagccagcggctccaactcctttcagccacatgccccaggctctcgctgccctgtggacaggatgaggacagagggcacatgaacagcttgccagggatgggcagcccaacagcacttttcctcttctagatggaccccagcatttaagtgaccttctgatcttggaaaaacagcgtcttccttctttatctatagcaactcattggtggtagccatcaagcacttcccaggatctgctccaacagaatattgctaggttttgctacatgacgggttgtgagacttctgtttgatcactgtgaaccaacccccatctccctagcccaccccgctccccaactccctctctgtgcattttctaagtgggacattcaaaaaactctctcccaggacctcggatgaccatactcagacgtgtgacctccatactgggctaaggaagtatcagcactagaaattgggcagtcttaatgttgaatgctgctttctgcttagtatttttttgattcaaggctcagaaggaatggtgcgtggcttccctgtcccagttgtggcaactaaaccaatcggtgtgttcttgatgcgggtcaacatttccaaaagtggctagtcctcacttctagatctcagccattctaactcatatgttcccaattaccaaggggtggccgggcacagtggctcacgcctgtaatcccagcactttgagaggctgaggtggtaggatcacctgaggtcaggagttcaagaccagcctgtccaacatggtgaaacccccatctctactaaaaataccaaaaattagccgagcgtagtgacgggtgcccgtaatcccagctactcaggaggctgagacaggagaatcacctgaaccccagaggcagaggttgcagtgagctgagatcacgccattgtactccagcctgggcaacaagagcaaaactccgtctcaaaaaaaaaaaaaaattacaaatggggcaaacagtctagtgtaatggatcaaattaagattctctgcccagccgggcacagtggcgcatgcctgtaatcccagaactttgggaggccaagacgggatgattgcttgagctcaggagtttgagaccaggctgggcatcatagcaagacctcatctctactaaaattcaaaaacaaaattagccgggcatgatggtgcatgcctgtagtctcagctagttggggagctaaggtgggagaattgcttgagcttgggaagtcgaggctgcagtcagccctgattgtgccagtgcactccggcctgggtgacagagtgagaccctgtctcaaaaaaaaaaagattctgtgtcagagcccagcccaggagtttgaggctgcaatgagccatgatttcccactgcactccagcctgagtgacagagcgagactccatctctttaaaaacaaacaaaaaattatctgaatgatcctgtctctaaaaagaagccacagaaatgtttaaaaacttcatcgacttagcctgagtcataacggttaagaaagcacttaaacagaagcagaggctaattcagtgtcacatgaggaagtagctgtcagatgtcacataattactttcgtaatagctcagattagaatggctaccccattctctagacaaaatcaaattgtcctattgtgactcttctaaaaatgaagatgaagagctatttaatgacacaccttggattaaaacgggaatcacatcttaaagctaaaaatgaacctgcaagccttctaaatgagtcactgagcatcactagtgacaagtctcgggtgagcgtaaatgggtcatgacaagatgggacagcaacaaaatcatggcttaggatcgacaagaagttaaaaaacagctgcatctgttacttaagtttgtaagacagtgccctgagacctctagagaaaagatgtttgtttacataagagaaagaggccagacatggtgtctcacacgtttaatcccagcactttgggaggcaggggcgggtggatcacctgaggtcaggagttcaagactagcctggccaacatggtgaaaccccgtctctactaaaaatacaaaaattagccgggcatggtggcaggcgcctataatcccagctactggggaggctgaggcaggagaatcacttgaacccgggggacagaggttgtagtgagccaagatcgcaccactgcactccagcctgggtcacagagtgagactccatctcaaaaaaaaaaaagagagagagagagaaagaaatagaagagaagagccatcttggcagggttattttatatctgagcaaggagtttaaatgagactagtttagattgtctgctgatgcagccgtccatagcagtacccctaaaatcccaccagaatacgggtccctctaacccagtggctggaagaaccactgtctagagcaacttttcttggaactgtcccagctaccaagtcagacaccaaggtttatgccaccaggtaacacgggaatcacaggtacatgtcgctccggtcagattagttggctttggcccctcgaccctgtgcaggagctagttctcagcttgcagctggaagttccctcttagctccttagtctagaggggtctcctggctccatttgaccctggtctttaataaccggtcagcatcttgctaccttctaccacctttccaaatctctggaaatcctgccagggaaagcctccagttccaacattggctttccaagcaaactggctttgccctctctctgccatccttgtcctccagagactgcaccacctgtagcatagaaaaccaccaccacggacctgccagccatcggcgcagcaaaccagccagctgtttgctgccaaattccttcctctcccaggtccagaccaaatacaagatcagcaccacaccgtggtgttgtcaggagccaaagcaacaggaaacaattcaatgctgttgggttcgattctgagagtagatttttccagacatgtctttcaggtgaccctcaactacctcaggtttgaaggccctaaatgaaactgattaccactcatagggacaaaccgagggggttcggttacatcttggtgataatgcagttgtctcaaacttataacagactctttcacatttcagtttgcagggatagggttgggtttgtttttcttctgtttttaacctttcccctgggtttccattagggtagttccttgaaatgaatttcatttttcactgagtgcctaccttcccagggcaggtggccactggcttctgtttccctccaacaatacttttattatggtattaagacctttctttgtataatacattgcatctgtgttttcaatttttcaaataaatatttccgcctggca

SEQ ID NO: 298448 - DNA, 1299 bp, Homo sapiens
ccgaaaattaccacagcgtggtgccaggcacctgcagtcccaactacttgggaggagaatggcctgaatcttggaagttgtggttgccatgagccaagatcgcaccactgcactccagcctgggtcacagagtgagactccatctcaaaaaaaaaaaagagagagagagagaaagaaatagaagagaagagccatcttggcagggttattttatatctgagcaaggagtttaaatgagactagtttagattgtctgctgatgcagccgtccatagcagtacccctaaaatcccaccagaatacgggtccctctaacccagtggctggaagaaccactgtctagagcaacttttcttggaactgtcccagctaccaagtcagacaccaaggtttatgccaccaggtaacacgggaatcacaggtacatgtcgctccggtcagattagttggctttggcccctcgaccctgtgcaggagctagttctcagcttgcagctggaagttccctcttagctccttagtctagaggggtctcctggctccatttgaccctggtctttaataaccggtcagcatcttgctaccttctaccacctttccaaatctctggaaatcctgccagggaaagcctccagttccaacattggctttccaagcaaactggctttgccctctctctgccatccttgtcctccagagactgcaccacctgtagcatagaaaaccaccaccacggacctgccagccatcggcgcagcaaaccagccagctgtttgctgccaaattccttcctctcccaggtccagaccaaatacaagatcagcaccacaccgtggtgttgtcaggagccaaagcaacaggaaacaattcaatgctgttgggttcgattctgagagtagatttttccagacatgtctttcaggtgaccctcaactacctcaggtttgaaggccctaaatgaaactgattaccactcatagggacaaaccgagggggttcggttacatcttggtgataatgcagttgtctcaaacttataacagactctttcacatttcagtttgcagggatagggttgggtttgtttttcttctgtttttaacctttcccctgggtttccattagggtagttccttgaaatgaatttcatttttcactgagtgcctaccttcccagggcaggtggccactggcttctgtttccctccaacaatacttttattatggtattaagacctttctttgtataatacattgcatctgtgttttcaatttttcaaataaatatttccgcctggca

SEQ ID NO: 298449 - DNA, 2067 bp, Homo sapiens
cacggcttggtcttaggtcctgtgtgactccagggaagtccagagaacagcctgttctcagatgatgttccctaacccagagccccctccagagactgtcagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaaagtgacgtgaacaactttttccagttaacagtggagatgtttgactacctggagtgtgaactcaacctcttccaaacagtattcaactccctggacatgtcccgctctgtgtccgtgacggcagcagggcagtgccgcctcgccccgctgatccaggtcatcttggactgcagccacctttatgactacactgtcaagcttctcttcaaactccactcctgcctcccagctgacaccctgcaaggccaccgggaccgcttcatggagcagtttacaaagttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgagagccagcgggttgtgctgcagctgaagggccacgtcagcgagctggaagcagatctggccgagcagcagcacctgcggcagcaggcggccgacgactgtgaattcctgcgggcagaactggacgagctcaggaggcagcgggaggacaccgagaaggctcagcggagcctgtctgagatagaaaggaaagctcaagccaatgaacagcgatatagcaagctaaaggagaagtacagcgagctggttcagaaccacgctgacctgctgcggaagaatgcagaggtgaccaaacaggtgtccatggccagacaagcccaggtagatttggaacgagagaaaaaagagctggaggattcgttggagcgcatcagtgaccagggccagcggaagactcaagaacagctggaagttctagagagcttgaagcaggaacttgccacaagccaacgggagcttcaggttctgcaaggcagcctggaaacttctgcccagtcagaagcaaactgggcagccgagttcgccgagctagagaaggagcgggacagcctggtgagtggcgcagctcatagggaggaggaattatctgctcttcggaaagaactgcaggacactcagctcaaactggccagcacagaggaatctatgtgccagcttgccaaagaccaacgaaaaatgcttctggtggggtccaggaaggctgcggagcaggtgatacaagacgccctgaaccagcttgaagaacctcctctcatcagctgcgctgggtctgcagatcacctcctctccacggtcacatccatttccagctgcatcgagcaactggagaaaagctggtcaagtgggccagcagggttatggaatggagaagtccacggagagagcgagctgagtggttgtgtgag

SEQ ID NO: 298450 - DNA, 1386 bp, Homo sapiens
cacggcttggtcttaggtcctgtgtgactccagggaagtccagagaacagcctgttctcagatgatgttccctaacccagagccccctccagagactgtcagcatcaataaggccattaatacgcaggaagtggctgtaaaggaaaaacacgccagaacgtgcatactgggcacccaccatgagaaaggggcacagaccttctggtctgttgtcaaccgcctgcctctgtctagcaacgcagtgctctgctggaagttctgccatgtgttccacaaactcctccgagatggacacccgaacgtcctgaaggactctctgagatacagaaatgaattgagtgacatgagcaggatgtggggccacctgagcgaggggtatggccagctgtgcagcatctacctgaaactgctaagaaccaagatggagtaccacaccaaaaatcccaggttcccaggcaacctgcagatgagtgaccgccagctggacgaggctggagaaagtgacgtgaacaactttttccagttaacagtggagatgtttgactacctggagtgtgaactcaacctcttccaaacagtattcaactccctggacatgtcccgctctgtgtccgtgacggcagcagggcagtgccgcctcgccccgctgatccaggtcatcttggactgcagccacctttatgactacactgtcaagcttctcttcaaactccactcctgcctcccagctgacaccctgcaaggccaccgggaccgcttcatggagcagtttacaaagttgaaagatctgttctaccgctccagcaacctgcagtacttcaagcggctcattcagatcccccagctgcctgagaacccacccaacttcctgcgagcctcagccctgtcagaacatatcagccctgtggtggtgatccctgcagaggcctcatcccccgacagcgagccagtcctagagaaggatgacctcatggacatggatgcctctcagcagaatttatttgacaacaagtttgatgacatctttggcagttcattcagcagtgatcccttcaatttcaacagtcaaaatggtgtgaacaaggatgagaaggaccacttaattgagcgactatacagagagatcagtggattgaaggcacagctagaaaacatgaagactgaggtactaaatcaaacttctcgacttgagatacagctgctggagaattcattatccacctacaagctagagaagcaacttcttcaacagacaaatgaaatcttgaagatccatgaaaaaaacagatggtcaatatactattcttgatcccacagaactatcgtgaaatttagtcaatgttaacgttttccccaccccaaataaatgaagcaaagtgaataaaa

SEQ ID NO: 298451 - DNA, 345 bp, Homo sapiens
aatttatttgacaacaagtttgatgacatctttggcagttcattcagcagtgatcccttcaatttcaacagtcaaaatggtgtgaacaaggatgagaagtgagtccaagctgggttcaagcagatggttcaggagctaagttaagccatggtctgcctcaaaacactaaccaaagaggaattcttaatgatactggggcttcttagatacagaacatcttgaagggttgggggcaatggcttatgcctgtaatcccaacatgtggggaggatgaggtaggaggattttttaaggccaggagtttaagaccaagcttgggcaacatagcaagatcccatctttatt

SEQ ID NO: 298452 - DNA, 749 bp, Homo sapiens
agtcccagctactcaggaggctgaggcaggagaatggcgtgaacccgggaggcggagcttgcagtgagccgagattgcgccactgcactccagcctgggtgacagagcgagactccatctcaaaaaaaaaaaaaaaaaaaaagaagggatcaggtgctgagaaatggagtggcatggagtcacattcaggctgccagcccagagacttgccatccatcacctcgagtctatatgttgttgtctgcatgtcgaaagcagtcaacttgatcacagccaagactgttcactcttagtggacttgactgactctgggcaccaaccatagacagatcctagtcattcctagacacgaaacttggggactatgtgattacaccatggttataattataatgtatttttgagcccccatggtggcaggttttgttggttaagtgaatgaatgcattcatgagtgctttgcaacataaattatcattgtcttttaggaacagaggcatctccacctacactgcaagaagtggtaaccgaaaaagaatagagccaaaccaacaccccatatgtcagtgtaaatccttgttacctatctcgtgtgtgttatttccccagccacaggccaaatccttggagtcccaggggcagccacaccactgccattacccagtgccgaggacatgcatgacacttccaaagactccctccatagcgacaccctttctgtttggacccatggtcatctctgttctttt

SEQ ID NO: 298453 - DNA, 5225 bp, Homo sapiens
ggccgccgggagccggggcccagcgcgtgcgcagacggagcgcgctgagcggagggggaggtggctgccgcttctcccgcgtccgccattttgttgctgtggctattgggaacaagctgggcaaaagcaccccggaggcgcgacgctccttcgagttcggtgcctcgtgtgacggcgggggtcggtgaagacccgtcgagctgcggcgccggcgcgttccaggccgggagtcactggaggcacccctgggacgccgagcagcccgagaaccccggggtggcctccgctgcggctcgggtttgcctgccccgaccccccggctctgccgtgcattcccgggcggctctctccgtgtggcggccccggagcaggcgggcggcgtcggaggatgctgcgggcccggagccgagaggaaagtgctggcccagccctctgagcgctcctcgaggtgtgcgagaggcccttcctcggccccaaagccgtctgccgggctaaggcgtgcagagcaggcgaggacagccgccgcccctaccgccgcagagtccccggtccaacaccatgtcctccgccaggttcgactcctcggaccgctccgcctggtatatggggccggtgtctcgccaggaggcgcagacccggctccagggccagcgccacggtatgttcctcgtccgcgattcttccacctgccctggggactatgtgctgtcggtgtccgagaactcgcgggtctcccactacatcatcaactcgctgcccaaccgccgttttaagatcggggaccaggaatttgaccatttgccggccctgctggagttttacaagatccactacctggacaccaccaccctcatcgagcctgcgcccaggtatccaagcccaccaatgggatctgtctcagcacccaacctgcctacagcagaagataacctggaatatgtacggactctgtatgattttcctgggaatgatgccgaagacctgccctttaaaaagggtgagatcctagtgataatagagaagcctgaagaacagtggtggagtgcccggaacaaggatggccgggttgggatgattcctgtcccttatgtcgaaaagcttgtgagatcctcaccacacggaaagcatggaaataggaattccaacagttatgggatcccagaacctgctcatgcatacgctcaacctcagaccacaactcctctacctgcagtttccggttctcctggggcagcaatcacccctttgccatccacacagaatggacctgtctttgcgaaagcaatccagaaaagagtaccctgtgcttatgacaagactgccttggcattagaggttggtgacatcgtgaaagtcacaaggatgaatataaatggccagtgggaaggcgaagtgaacgggcgcaaagggcttttcccctttacgcacgtcaaaatctttgaccctcaaaacccagatgaaaacgagtgattgctgttgccctgtttcctgctgctttgttgttctgcctgtcctagtctcctttgaagtgggaaagcattttctctcataggcaagtcacactgcattgccgaagtccagctttctgcagactggcagtcgcacacacatttggaatgcacacagcggctgcctcctgatgtttgtatcatagtcgtattgtcaaagagtagccgattttagagttcttttggatcataaactggaaatactgatggaagcacacaagtggagagaagttgacgtggaaagggtcttccttctcattgctgcccgtttgtacatgggactgattctgtcgtgttcaccagagaaagcttgaggccatggcgagatactgcatgtttgctgttccacaaagcagtggcttagctgccatcttgcttttctttggacaacaggaagtgaaccttaaggaagagagaattctgttctaaaactccaaaatctggctttttttttttctttggtttgggttgggtttgggaaaactaattaattagacttgtgtgggggttttttttgttttgttttgtttgttttgttttgtttttttgagacggtgtctcgctgcatcacccaggctggagtgcagtggcgcaatctcgccttcctgcagtctccgcctcctgagttcaagcgattctcctgcctcagcctcccaagttagctgggactgcaggcgcgcacaccacgcccagctaattttggtatttttagtagagacggggtttcatcatgttgaccaggctggtctcaaactcctgacttcaggtgatccacccgccttcagcctcccaacgtgctgggattacagccgtgagccgccgcgcctggcctagacttgtgtgttctaaacaggttaagtagcaggttgggtttttatgatagtgcaaggaatgactcatgcctctgagcttctaaactgaagctgctgtaactaaaggaatctgaaaagaacaaccctgaagcagaggcctttattgtcttggttgccagtagtaccttgttttgccatgtagcagacaacacacaaaataatgcagttgtggtgtgccatgctatgtgcacagccccttggattactttgttttaaaaagcatcagagttgggggtactttagggaaacctttgcttaccttgttttgccagtgataagagcagtgggttggagggcacttggccagttttctgttcagcttttcagtgaatgtacccctttaaggttcagacttaaacttccttaaaaagtggcgttgttcatagaatcgttggactcattaatgaatcgttcaactccactcactgaagcccagacctccgtgcccaggcccaatctcgtcaggctgccagagaaagttggtgctgctcatactggtctcacagtctaagtaagtgtctgtgatgctcccaagcaaaggaaatgcaagctctggaaattcgttaatgtatttgatgtcttagtgttttagtgactagggagaccattaactagtttatcattaaccacttatcagtgtattgatgttaaagcatttccctgttagctaaaagaggcctgttcatacaagccaactggtatatacgtgtggttcatccatcatctgctgcacatagcagactagaattctgggaaccctgtgcaattcagtctgctctcccttgtggaccctggtaaagaaaagcctcagctcatagtgaacacagcagacctagaaatgtagcagcagcctactgagtagctttcatttactgatcatctgctgtgactgtggccctgtctggaggttcctaggttttgagatttagagcaatgcattctggagacagaaccagcagaacagccatttttcaatttttctttaaatcagtattccatcaggcagataactgctgtattcatgaatcttgagagtgttcctgagacagaattaatggtcatttgggaaaactatcgccatggcttcccatctgtggttttcctctaaaagccttggagattagcccttccttgccagtgagaacggtgaccgcctcctgctctgcacggtctgcggcagttgccgcttctggttaggtgtgtcaggttggcttattttgggttcaggcctggcgtagcacccacaagtggcagacatatcacaagagtccccagactctgcctagaaacagtgtttgccctttggccagtgacgtggttcatcccggcccatgttgagccatgagtggagtttccagcagagggaggaatgtgtgccttgttcaaggagggcacgacccttaggcctttttcaaccagatttagctgaagggcttgacacctttgaattacagcagttgactcagagtgcaagaagtctggccattttggaaagcaaggtttcctttcagccctgtctactgaccaataccccgactcaccttgtgtggcgcacttcagaatcagatatacctagagtatacctgtggtttggttttataattaatcagctcgttacttcagcccatgaaaatggcatccagggctgccaggagattcagagctcaaaacaaggcgagcttgagttctgcactccagatgtgtgccaaaactagtaaaacttaacggacttacaaccttgtcagtttttttaatgaggcagggatactctgtttttcacactaaacatatgaatgcagcactgctgcctcagctcagcttcgtgcctgggttccccactggtctgggaagactgttgtgctccatagagcagtgcacatctgacccagagggtgggtgttcataactgctacttgctctgctctaccatgtttaaagaaatatttggatgttaaattaactcactatggtttttcacctgggaaggaaacaaattacgtactagagggcattgattggttaaaaacttgtgtatcccgggaaggacctgcggtacaggagtcagccatgtctgtgctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgttttaacacagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaata

SEQ ID NO: 298454 - DNA, 5370 bp, Homo sapiens
ggccgccgggagccggggcccagcgcgtgcgcagacggagcgcgctgagcggagggggaggtggctgccgcttctcccgcgtccgccattttgttgctgtggctattgggaacaagctgggcaaaagcaccccggaggcgcgacgctccttcgagttcggtgcctcgtgtgacggcgggggtcggtgaagacccgtcgagctgcggcgccggcgcgttccaggccgggagtcactggaggcacccctgggacgccgagcagcccgagaaccccggggtggcctccgctgcggctcgggtttgcctgccccgaccccccggctctgccgtgcattcccgggcggctctctccgtgtggcggccccggagcaggcgggcggcgtcggaggatgctgcgggcccggagccgagaggaaagtgctggcccagccctctgagcgctcctcgaggtgtgcgagaggcccttcctcggccccaaagccgtctgccgggctaaggcgtgcagagcaggcgaggacagccgccgcccctaccgccgcagagtccccggtccaacaccatgtcctccgccaggttcgactcctcggaccgctccgcctggtatatggggccggtgtctcgccaggaggcgcagacccggctccagggccagcgccacggtatgttcctcgtccgcgattcttccacctgccctggggactatgtgctgtcggtgtccgagaactcgcgggtctcccactacatcatcaactcgctgcccaaccgccgttttaagatcggggaccaggaatttgaccatttgccggccctgctggagttttacaagatccactacctggacaccaccaccctcatcgagcctgcgcccaggtatccaagcccaccaatgggatctgtctcagcacccaacctgcctacagcagaagataacctggaatatgtacggactctgtatgattttcctgggaatgatgccgaagacctgccctttaaaaagggtgagatcctagtgataatagagaagcctgaagaacagtggtggagtgcccggaacaaggatggccgggttgggatgattcctgtcccttatgtcgaaaagcttgtgagatcctcaccacacggaaagcatggaaataggaattccaacagttatgggatcccagaacctgctcatgcatacgctcaacctcagaccacaactcctctacctgcagtttccggttctcctggggcagcaatcacccctttgccatccacacagaatggacctgtctttgcgaaagcaatccagaaaagagtaccctgtgcttatgacaagactgccttggcattagaggttggtgacatcgtgaaagtcacaaggatgaatataaatggccagtgggaaggcgaagtgaacgggcgcaaagggcttttcccctttacgcacgtcaaaatctttgaccctcaaaacccagatgaaaacgagtgattgctgttgccctgtttcctgctgctttgttgttctgcctgtcctagtctcctttgaagtgggaaagcattttctctcataggcaagtcacactgcattgccgaagtccagctttctgcagactggcagtcgcacacacatttggaatgcacacagcggctgcctcctgatgtttgtatcatagtcgtattgtcaaagagtagccgattttagagttcttttggatcataaactggaaatactgatggaagcacacaagtggagagaagttgacgtggaaagggtcttccttctcattgctgcccgtttgtacatgggactgattctgtcgtgttcaccagagaaagcttgaggccatggcgagatactgcatgtttgctgttccacaaagcagtggcttagctgccatcttgcttttctttggacaacaggaagtgaaccttaaggaagagagaattctgttctaaaactccaaaatctggctttttttttttctttggtttgggttgggtttgggaaaactaattaattagacttgtgtgggggttttttttgttttgttttgtttgttttgttttgtttttttgagacggtgtctcgctgcatcacccaggctggagtgcagtggcgcaatctcgccttcctgcagtctccgcctcctgagttcaagcgattctcctgcctcagcctcccaagttagctgggactgcaggcgcgcacaccacgcccagctaattttggtatttttagtagagacggggtttcatcatgttgaccaggctggtctcaaactcctgacttcaggtgatccacccgccttcagcctcccaacgtgctgggattacagccgtgagccgccgcgcctggcctagacttgtgtgttctaaacaggttaagtagcaggttgggtttttatgatagtgcaaggaatgactcatgcctctgagcttctaaactgaagctgctgtaactaaaggaatctgaaaagaacaaccctgaagcagaggcctttattgtcttggttgccagtagtaccttgttttgccatgtagcagacaacacacaaaataatgcagttgtggtgtgccatgctatgtgcacagccccttggattactttgttttaaaaagcatcagagttgggggtactttagggaaacctttgcttaccttgttttgccagtgataagagcagtgggttggagggcacttggccagttttctgttcagcttttcagtgaatgtacccctttaaggttcagacttaaacttccttaaaaagtggcgttgttcatagaatcgttggactcattaatgaatcgttcaactccactcactgaagcccagacctccgtgcccaggcccaatctcgtcaggctgccagagaaagttggtgctgctcatactggtctcacagtctaagtaagtgtctgtgatgctcccaagcaaaggaaatgcaagctctggaaattcgttaatgtatttgatgtcttagtgttttagtgactagggagaccattaactagtttatcattaaccacttatcagtgtattgatgttaaagcatttccctgttagctaaaagaggcctgttcatacaagccaactggtatatacgtgtggttcatccatcatctgctgcacatagcagactagaattctgggaaccctgtgcaattcagtctgctctcccttgtggaccctggtaaagaaaagcctcagctcatagtgaacacagcagacctagaaatgtagcagcagcctactgagtagctttcatttactgatcatctgctgtgactgtggccctgtctggaggttcctaggttttgagatttagagcaatgcattctggagacagaaccagcagaacagccatttttcaatttttctttaaatcagtattccatcaggcagataactgctgtattcatgaatcttgagagtgttcctgagacagaattaatggtcatttgggaaaactatcgccatggcttcccatctgtggttttcctctaaaagccttggagattagcccttccttgccagtgagaacggtgaccgcctcctgctctgcacggtctgcggcagttgccgcttctggttaggtgtgtcaggttggcttattttgggttcaggcctggcgtagcacccacaagtggcagacatatcacaagagtccccagactctgcctagaaacagtgtttgccctttggccagtgacgtggttcatcccggcccatgttgagccatgagtggagtttccagcagagggaggaatgtgtgccttgttcaaggagggcacgacccttaggcctttttcaaccagatttagctgaagggcttgacacctttgaattacagcagttgactcagagtgcaagaagtctggccattttggaaagcaaggtttcctttcagccctgtctactgaccaataccccgactcaccttgtgtggcgcacttcagaatcagatatacctagagtatacctgtggtttggttttataattaatcagctcgttacttcagcccatgaaaatggcatccagggctgccaggagattcagagctcaaaacaaggcgagcttgagttctgcactccagatgtgtgccaaaactagtaaaacttaacggacttacaaccttgtcagtttttttaatgaggcagggatactctgtttttcacactaaacatatgaatgcagcactgctgcctcagctcagcttcgtgcctgggttccccactggtctgggaagactgttgtgctccatagagcagtgcacatctgacccagagggtgggtgttcataactgctacttgctctgctctaccatgtttaaagaaatatttggatgttaaattaactcactatggtttttcacctgggaaggaaacaaattacgtactagagggcattgattggttaaaaacttgtgtatcccgggaaggacctgcggtacaggagtcagccatgtctgtgctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgttttaacacagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaatacatcgagtgtcttttcttaacagattagtgcctttttatttttgtattccgttttacgttactggtcccagcatcaaaacccttgtttccatggcctgtttgtatattgtctcaataaaacttgcatcagccggtggtggcggca

SEQ ID NO: 298455 - DNA, 5172 bp, Homo sapiens
ggccgccgggagccggggcccagcgcgtgcgcagacggagcgcgctgagcggagggggaggtggctgccgcttctcccgcgtccgccattttgttgctgtggctattgggaacaagctgggcaaaagcaccccggaggcgcgacgctccttcgagttcggtgcctcgtgtgacggcgggggtcggtgaagacccgtcgagctgcggcgccggcgcgttccaggccgggagtcactggaggcacccctgggacgccgagcagcccgagaaccccggggtggcctccgctgcggctcgggtttgcctgccccgaccccccggctctgccgtgcattcccgggcggctctctccgtgtggcggccccggagcaggcgggcggcgtcggaggatgctgcgggcccggagccgagaggaaagtgctggcccagccctctgagcgctcctcgaggtgtgcgagaggcccttcctcggccccaaagccgtctgccgggctaaggcgtgcagagcaggcgaggacagccgccgcccctaccgccgcagagtccccggtccaacaccatgtcctccgccaggttcgactcctcggaccgctccgcctggtatatggggccggtgtctcgccaggaggcgcagacccggctccagggccagcgccacggtatgttcctcgtccgcgattcttccacctgccctggggactatgtgctgtcggtgtccgagaactcgcgggtctcccactacatcatcaactcgctgcccaaccgccgttttaagatcggggaccaggaatttgaccatttgccggccctgctggagttttacaagatccactacctggacaccaccaccctcatcgagcctgcgcccaggtatccaagcccaccaatgggatctgtctcagcacccaacctgcctacagcagaagataacctggaatatgtacggactctgtatgattttcctgggaatgatgccgaagacctgccctttaaaaagggtgagatcctagtgataatagagaagcctgaagaacagtggtggagtgcccggaacaaggatggccgggttgggatgattcctgtcccttatgtcgaaaagcttgtgagatcctcaccacacggaaagcatggaaataggaattccaacagttatgggatcccagaacctgctcatgcatacgctcaacctcagaccacaactcctctacctgcagtttccggttctcctggggcagcaatcacccctttgccatccacacagaatggacctgtctttgcgaaagcaatccagaaaagagtaccctgtgcttatgacaagactgccttggcattagaggttggtgacatcgtgaaagtcacaaggatgaatataaatggccagtgggaaggcgaagtgaacgggcgcaaagggcttttcccctttacgcacgtcaaaatctttgaccctcaaaacccagatgaaaacgagtgattgctgttgccctgtttcctgctgctttgttgttctgcctgtcctagtctcctttgaagtgggaaagcattttctctcataggcaagtcacactgcattgccgaagtccagctttctgcagactggcagtcgcacacacatttggaatgcacacagcggctgcctcctgatgtttgtatcatagtcgtattgtcaaagagtagccgattttagagttcttttggatcataaactggaaatactgatggaagcacacaagtggagagaagttgacgtggaaagggtcttccttctcattgctgcccgtttgtacatgggactgattctgtcgtgttcaccagagaaagcttgaggccatggcgagatactgcatgtttgctgttccacaaagcagtggcttagctgccatcttgcttttctttggacaacaggaagtgaaccttaaggaagagagaattctgttctaaaactccaaaatctggctttttttttttctttggtttgggttgggtttgggaaaactaattaattagacttgtgtgggggttttttttgttttgttttgtttgttttgttttgtttttttgagacggtgtctcgctgcatcacccaggctggagtgcagtggcgcaatctcgccttcctgcagtctccgcctcctgagttcaagcgattctcctgcctcagcctcccaagttagctgggactgcaggcgcgcacaccacgcccagctaattttggtatttttagtagagacggggtttcatcatgttgaccaggctggtctcaaactcctgacttcaggtgatccacccgccttcagcctcccaacgtgctgggattacagccgtgagccgccgcgcctggcctagacttgtgtgttctaaacaggttaagtagcaggttgggtttttatgatagtgcaaggaatgactcatgcctctgagcttctaaactgaagctgctgtaactaaaggaatctgaaaagaacaaccctgaagcagaggcctttattgtcttggttgccagtagtaccttgttttgccatgtagcagacaacacacaaaataatgcagttgtggtgtgccatgctatgtgcacagccccttggattactttgttttaaaaagcatcagagttgggggtactttagggaaacctttgcttaccttgttttgccagtgataagagcagtgggttggagggcacttggccagttttctgttcagcttttcagtgaatgtacccctttaaggttcagacttaaacttccttaaaaagtggcgttgttcatagaatcgttggactcattaatgaatcgttcaactccactcactgaagcccagacctccgtgcccaggcccaatctcgtcaggctgccagagaaagttggtgctgctcatactggtctcacagtctaagtaagtgtctgtgatgctcccaagcaaaggaaatgcaagctctggaaattcgttaatgtatttgatgtcttagtgttttagtgactagggagaccattaactagtttatcattaaccacttatcagtgtattgatgttaaagcatttccctgttagctaaaagaggcctgttcatacaagccaactggtatatacgtgtggttcatccatcatctgctgcacatagcagactagaattctgggaaccctgtgcaattcagtctgctctcccttgtggaccctggtaaagaaaagcctcagctcatagtgaacacagcagacctagaaatgtagcagcagcctactgagtagctttcatttactgatcatctgctgtgactgtggccctgtctggaggttcctaggttttgagatttagagcaatgcattctggagacagaaccagcagaacagccatttttcaatttttctttaaatcagtattccatcaggcagataactgctgtattcatgaatcttgagagtgttcctgagacagaattaatggtcatttgggaaaactatcgccatggcttcccatctgtggttttcctctgctctgcacggtctgcggcagttgccgcttctggttaggtgtgtcaggttggcttattttgggttcaggcctggcgtagcacccacaagtggcagacatatcacaagagtccccagactctgcctagaaacagtgtttgccctttggccagtgacgtggttcatcccggcccatgttgagccatgagtggagtttccagcagagggaggaatgtgtgccttgttcaaggagggcacgacccttaggcctttttcaaccagatttagctgaagggcttgacacctttgaattacagcagttgactcagagtgcaagaagtctggccattttggaaagcaaggtttcctttcagccctgtctactgaccaataccccgactcaccttgtgtggcgcacttcagaatcagatatacctagagtatacctgtggtttggttttataattaatcagctcgttacttcagcccatgaaaatggcatccagggctgccaggagattcagagctcaaaacaaggcgagcttgagttctgcactccagatgtgtgccaaaactagtaaaacttaacggacttacaaccttgtcagtttttttaatgaggcagggatactctgtttttcacactaaacatatgaatgcagcactgctgcctcagctcagcttcgtgcctgggttccccactggtctgggaagactgttgtgctccatagagcagtgcacatctgacccagagggtgggtgttcataactgctacttgctctgctctaccatgtttaaagaaatatttggatgttaaattaactcactatggtttttcacctgggaaggaaacaaattacgtactagagggcattgattggttaaaaacttgtgtatcccgggaaggacctgcggtacaggagtcagccatgtctgtgctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgttttaacacagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaata

SEQ ID NO: 298456 - DNA, 5738 bp, Homo sapiens
ggccgccgggagccggggcccagcgcgtgcgcagacggagcgcgctgagcggagggggaggtggctgccgcttctcccgcgtccgccattttgttgctgtggctattgggaacaagctgggcaaaagcaccccggaggcgcgacgctccttcgagttcggtgcctcgtgtgacggcgggggtcggtgaagacccgtcgagctgcggcgccggcgcgttccaggccgggagtcactggaggcacccctgggacgccgagcagcccgagaaccccggggtggcctccgctgcggctcgggtttgcctgccccgaccccccggctctgccgtgcattcccgggcggctctctccgtgtggcggccccggagcaggcgggcggcgtcggaggatgctgcgggcccggagccgagaggaaagtgctggcccagccctctgagcgctcctcgaggtgtgcgagaggcccttcctcggccccaaagccgtctgccgggctaaggcgtgcagagcaggcgaggacagccgccgcccctaccgccgcagagtccccggtccaacaccatgtcctccgccaggttcgactcctcggaccgctccgcctggtatatggggccggtgtctcgccaggaggcgcagacccggctccagggccagcgccacggtatgttcctcgtccgcgattcttccacctgccctggggactatgtgctgtcggtgtccgagaactcgcgggtctcccactacatcatcaactcgctgcccaaccgccgttttaagatcggggaccaggaatttgaccatttgccggccctgctggagttttacaagatccactacctggacaccaccaccctcatcgagcctgcgcccaggtatccaagcccaccaatgggatctgtctcagcacccaacctgcctacagcagaagataacctggaatatgtacggactctgtatgattttcctgggaatgatgccgaagacctgccctttaaaaagggtgagatcctagtgataatagagaagcctgaagaacagtggtggagtgcccggaacaaggatggccgggttgggatgattcctgtcccttatgtcgaaaagcttgtgagatcctcaccacacggaaagcatggaaataggaattccaacagttatgggatcccagaacctgctcatgcatacgctcaacctcagaccacaactcctctacctgcagtttccggttctcctggggcagcaatcacccctttgccatccacacagaatggacctgtctttgcgaaagcaatccagaaaagagtaccctgtgcttatgacaagactgccttggcattagaggttggtgacatcgtgaaagtcacaaggatgaatataaatggccagtgggaaggcgaagtgaacgggcgcaaagggcttttcccctttacgcacgtcaaaatctttgaccctcaaaacccagatgaaaacgagtgattgctgttgccctgtttcctgctgctttgttgttctgcctgtcctagtctcctttgaagtgggaaagcattttctctcataggcaagtcacactgcattgccgaagtccagctttctgcagactggcagtcgcacacacatttggaatgcacacagcggctgcctcctgatgtttgtatcatagtcgtattgtcaaagagtagccgattttagagttcttttggatcataaactggaaatactgatggaagcacacaagtggagagaagttgacgtggaaagggtcttccttctcattgctgcccgtttgtacatgggactgattctgtcgtgttcaccagagaaagcttgaggccatggcgagatactgcatgtttgctgttccacaaagcagtggcttagctgccatcttgcttttctttggacaacaggaagtgaaccttaaggaagagagaattctgttctaaaactccaaaatctggctttttttttttctttggtttgggttgggtttgggaaaactaattaattagacttgtgtgggggttttttttgttttgttttgtttgttttgttttgtttttttgagacggtgtctcgctgcatcacccaggctggagtgcagtggcgcaatctcgccttcctgcagtctccgcctcctgagttcaagcgattctcctgcctcagcctcccaagttagctgggactgcaggcgcgcacaccacgcccagctaattttggtatttttagtagagacggggtttcatcatgttgaccaggctggtctcaaactcctgacttcaggtgatccacccgccttcagcctcccaacgtgctgggattacagccgtgagccgccgcgcctggcctagacttgtgtgttctaaacaggttaagtagcaggttgggtttttatgatagtgcaaggaatgactcatgcctctgagcttctaaactgaagctgctgtaactaaaggaatctgaaaagaacaaccctgaagcagaggcctttattgtcttggttgccagtagtaccttgttttgccatgtagcagacaacacacaaaataatgcagttgtggtgtgccatgctatgtgcacagccccttggattactttgttttaaaaagcatcagagttgggggtactttagggaaacctttgcttaccttgttttgccagtgataagagcagtgggttggagggcacttggccagttttctgttcagcttttcagtgaatgtacccctttaaggttcagacttaaacttccttaaaaagtggcgttgttcatagaatcgttggactcattaatgaatcgttcaactccactcactgaagcccagacctccgtgcccaggcccaatctcgtcaggctgccagagaaagttggtgctgctcatactggtctcacagtctaagtaagtgtctgtgatgctcccaagcaaaggaaatgcaagctctggaaattcgttaatgtatttgatgtcttagtgttttagtgactagggagaccattaactagtttatcattaaccacttatcagtgtattgatgttaaagcatttccctgttagctaaaagaggcctgttcatacaagccaactggtatatacgtgtggttcatccatcatctgctgcacatagcagactagaattctgggaaccctgtgcaattcagtctgctctcccttgtggaccctggtaaagaaaagcctcagctcatagtgaacacagcagacctagaaatgtagcagcagcctactgagtagctttcatttactgatcatctgctgtgactgtggccctgtctggaggttcctaggttttgagatttagagcaatgcattctggagacagaaccagcagaacagccatttttcaatttttctttaaatcagtattccatcaggcagataactgctgtattcatgaatcttgagagtgttcctgagacagaattaatggtcatttgggaaaactatcgccatggcttcccatctgtggttttcctctaaaagccttggagattagcccttccttgccagtgagaacggtgaccgcctcctgctctgcacggtctgcggcagttgccgcttctggttaggtgtgtcaggttggcttattttgggttcaggcctggcgtagcacccacaagtggcagacatatcacaagagtccccagactctgcctagaaacagtgtttgccctttggccagtgacgtggttcatcccggcccatgttgagccatgagtggagtttccagcagagggaggaatgtgtgccttgttcaaggagggcacgacccttaggcctttttcaaccagatttagctgaagggcttgacacctttgaattacagcagttgactcagagtgcaagaagtctggccattttggaaagcaaggtttcctttcagccctgtctactgaccaataccccgactcaccttgtgtggcgcacttcagaatcagatatacctagagtatacctgtggtttggttttataattaatcagctcgttacttcagcccatgaaaatggcatccagggctgccaggagattcagagctcaaaacaaggcgagcttgagttctgcactccagatgtgtgccaaaactagtaaaacttaacggacttacaaccttgtcagtttttttaatgaggcagggatactctgtttttcacactaaacatatgaatgcagcactgctgcctcagctcagcttcgtgcctgggttccccactggtctgggaagactgttgtgctccatagagcagtgcacatctgacccagagggtgggtgttcataactgctacttgctctgctctaccatgtttaaagaaatatttggatgttaaattaactcactatggtttttcacctgggaaggaaacaaattacgtactagagggcattgattggttaaaaacttgtgtatcccgggaaggacctgcggtacaggagtcagccatgtctgtgctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgttttaacacagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaatacatcgagtgtcttttcttaacagattagtgcctttttatttttgtattccgttttacgttactggtcccagcatcaaaacccttgtttccatggcctgtttgtatattgtctcaataaaacttgcatcagccggtggtggcggcagcttcggtgtttcagtgtctcctcagtccgcccccactagcctcctggcagttcatcagtggtgaaatctctgatgcttctcagagacccttagtgctgctgctgaccaagagctagaatgaagtcttggcatccgcccattccaacactcgggcacccagaggagagcacctggggtctccctccaaaagagaaatctccctcccagagtgtctgtcttgtaggtattgtatgggagcctagtgcttggccttctgagcatgaggcaatagttcccacaggttgcaccaccacagagaacttggatctttttccttctaggcacccatatctgaggcttctagtaaatatttcttcagcatgagcta

SEQ ID NO: 298457 - DNA, 2652 bp, Homo sapiens
cccaacaccacacaaacaacacaaacacacaatagacacgtacagagcccgtgttaatctgcatgaggctaggatctgagatttagagcagtgggttggagggcacttggccagttttctgttcagcttttcagtgaatgtacccctttaaggttcagacttaaacttccttaaaaagtggcgttgttcatagaatcgttggactcattaatgaatcgttcaactccactcactgaagcccagacctccgtgcccaggcccaatctcgtcaggctgccagagaaagttggtgctgctcatactggtctcacagtctaagtaagtgtctgtgatgctcccaagcaaaggaaatgcaagctctggaaattcgttaatgtatttgatgtcttagtgttttagtgactagggagaccattaactagtttatcattaaccacttatcagtgtattgatgttaaagcatttccctgttagctaaaagaggcctgttcatacaagccaactggtatatacgtgtggttcatccatcatctgctgcacatagcagactagaattctgggaaccctgtgcaattcagtctgctctcccttgtggaccctggtaaagaaaagcctcagctcatagtgaacacagcagacctagaaatgtagcagcagcctactgagtagctttcatttactgatcatctgctgtgactgtggccctgtctggaggttcctaggttttgagatttagagcaatgcattctggagacagaaccagcagaacagccatttttcaatttttctttaaatcagtattccatcaggcagataactgctgtattcatgaatcttgagagtgttcctgagacagaattaatggtcatttgggaaaactatcgccatggcttcccatctgtggttttcctctaaaagccttggagattagcccttccttgccagtgagaacggtgaccgcctcctgctctgcacggtctgcggcagttgccgcttctggttaggtgtgtcaggttggcttattttgggttcaggcctggcgtagcacccacaagtggcagacatatcacaagagtccccagactctgcctagaaacagtgtttgccctttggccagtgacgtggttcatcccggcccatgttgagccatgagtggagtttccagcagagggaggaatgtgtgccttgttcaaggagggcacgacccttaggcctttttcaaccagatttagctgaagggcttgacacctttgaattacagcagttgactcagagtgcaagaagtctggccattttggaaagcaaggtttcctttcagccctgtctactgaccaataccccgactcaccttgtgtggcgcacttcagaatcagatatacctagagtatacctgtggtttggttttataattaatcagctcgttacttcagcccatgaaaatggcatccagggctgccaggagattcagagctcaaaacaaggcgagcttgagttctgcactccagatgtgtgccaaaactagtaaaacttaacggacttacaaccttgtcagtttttttaatgaggcagggatactctgtttttcacactaaacatatgaatgcagcactgctgcctcagctcagcttcgtgcctgggttccccactggtctgggaagactgttgtgctccatagagcagtgcacatctgacccagagggtgggtgttcataactgctacttgctctgctctaccatgtttaaagaaatatttggatgttaaattaactcactatggtttttcacctgggaaggaaacaaattacgtactagagggcattgattggttaaaaacttgtgtatcccgggaaggacctgcggtacaggagtcagccatgtctgtgctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgttttaacacagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaata

SEQ ID NO: 298458 - DNA, 1573 bp, Homo sapiens
tccctctactgagaaactgtgtatggctctttggcctcctgacgtgtgttctcccggacatggttgccgcctcgttcagttcgcgcccggtgagggatgtgtgccctttgtctcggcgggcacgcatcttacgtcgtttctggccgtcattttctacgtggcttgacacctttgaattacagcagttgactcagagtgcaagaagtctggccattttggaaagcaaggtttcctttcagccctgtctactgaccaataccccgactcaccttgtgtggcgcacttcagaatcagatatacctagagtatacctgtggtttggttttataattaatcagctcgttacttcagcccatgaaaatggcatccagggctgccaggagattcagagctcaaaacaaggcgagcttgagttctgcactccagatgtgtgccaaaactagtaaaacttaacggacttacaaccttgtcagtttttttaatgaggcagggatactctgtttttcacactaaacatatgaatgcagcactgctgcctcagctcagcttcgtgcctgggttccccactggtctgggaagactgttgtgctccatagagcagtgcacatctgacccagagggtgggtgttcataactgctacttgctctgctctaccatgtttaaagaaatatttggatgttaaattaactcactatggtttttcacctgggaaggaaacaaattacgtactagagggcattgattggttaaaaacttgtgtatcccgggaaggacctgcggtacaggagtcagccatgtctgtgctgtgtggaaccacctgatgacatggttaacgaggaagacgatgtgttgaccggctgccgtttgaggactttggtcacccagactagacaccttctgtgctcatgtttggaaagctgaaagggaaggacagctgtgccctcctgggagctcatgtgtccctggcgctgtgctagctttcctttacagctgtttacagacaaggcaggcctgaggcagatggccactgctcttgtgatgtttgctcagaggaatatgaacattttatttttgaaaagggatgatgtggttttttgccaggtgtttataattaatcctttaatattatggttattaacctcttaaacatgaatgaattcttgattgttttaacacagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaata

SEQ ID NO: 298459 - DNA, 3285 bp, Homo sapiens
ggccgccgggagccggggcccagcgcgtgcgcagacggagcgcgctgagcggagggggaggtggctgccgcttctcccgcgtccgccattttgttgctgtggctattgggaacaagctgggcaaaagcaccccggaggcgcgacgctccttcgagttcggtgcctcgtgtgacggcgggggtcggtgaagacccgtcgagctgcggcgccggcgcgttccaggccgggagtcactggaggcacccctgggacgccgagcagcccgagaaccccggggtggcctccgctgcggctcgggtttgcctgccccgaccccccggctctgccgtgcattcccgggcggctctctccgtgtggcggccccggagcaggcgggcggcgtcggaggatgctgcgggcccggagccgagaggaaagtgctggcccagccctctgagcgctcctcgaggtgtgcgagaggcccttcctcggccccaaagccgtctgccgggctaaggcgtgcagagcaggcgaggacagccgccgcccctaccgccgcagagtccccggtccaacaccatgtcctccgccaggttcgactcctcggaccgctccgcctggtatatggggccggtgtctcgccaggaggcgcagacccggctccagggccagcgccacggtatgttcctcgtccgcgattcttccacctgccctggggactatgtgctgtcggtgtccgagaactcgcgggtctcccactacatcatcaactcgctgcccaaccgccgttttaagatcggggaccaggaatttgaccatttgccggccctgctggagttttacaagatccactacctggacaccaccaccctcatcgagcctgcgcccaggtatccaagcccaccaatgggatctgtctcagcacccaacctgcctacagcagaagataacctggaatatgtacggactctgtatgattttcctgggaatgatgccgaagacctgccctttaaaaagggtgagatcctagtgataatagagaagcctgaagaacagtggtggagtgcccggaacaaggatggccgggttgggatgattcctgtcccttatgtcgaaaagcttgtgagatcctcaccacacggaaagcatggaaataggaattccaacagttatgggatcccagaacctgctcatgcatacgctcaacctcagaccacaactcctctacctgcagtttccggttctcctggggcagcaatcacccctttgccatccacacagaatggacctgtctttgcgaaagcaatccagaaaagagtaccctgtgcttatgacaagactgccttggcattagaggttggtgacatcgtgaaagtcacaaggatgaatataaatggccagtgggaaggcgaagtgaacgggcgcaaagggcttttcccctttacgcacgtcaaaatctttgaccctcaaaacccagatgaaaacgagtgattgctgttgccctgtttcctgctgctttgttgttctgcctgtcctagtctcctttgaagtgggaaagcattttctctcataggcaagtcacactgcattgccgaagtccagctttctgcagactggcagtcgcacacacatttggaatgcacacagcggctgcctcctgatgtttgtatcatagtcgtattgtcaaagagtagccgattttagagttcttttggatcataaactggaaatactgatggaagcacacaagtggagagaagttgacgtggaaagggtcttccttctcattgctgcccgtttgtacatgggactgattctgtcgtgttcaccagagaaagcttgaggccatggcgagatactgcatgtttgctgttccacaaagcagtggcttagctgccatcttgcttttctttggacaacaggaagtgaaccttaaggaagagagaattctgttctaaaactccaaaatctggctttttttttttctttggtttgggttgggtttgggaaaactaattaattagacttgtgtgggggttttttttgttttgttttgtttgttttgttttgtttttttgagacggtgtctcgctgcatcacccaggctggagtgcagtggcgcaatctcgccttcctgcagtctccgcctcctgagttcaagcgattctcctgcctcagcctcccaagttagctgggactgcaggcgcgcacaccacgcccagctaattttggtatttttagtagagacggggtttcatcatgttgaccaggctggtctcaaactcctgacttcaggtgatccacccgccttcagcctcccaacgtgctgggattacagccgtgagccgccgcgcctggcctagacttgtgtgttctaaacaggttaagtagcaggttgggtttttatgatagtgcaaggaatgactcatgcctctgagcttctaaactgaagctgctgtaactaaaggaatctgaaaagaacaaccctgaagcagaggcctttattgtcttggttgccagtagtaccttgttttgccatgtagcagacaacacacaaaataatgcagttgtggtgtgccatgctatgtgcacagccccttggattactttgttttaaaaagcatcagagttgggggtactttagggaaacctttgcttaccttgttttgccagtgataagagcagtgggttggagggcacttggccagttttctgttcagcttttcagtgaatgtacccctttaaggttcagacttaaacttccttaaaaagtggcgttgttcatagaatcgttggactcattaatgaatcgttcaactccactcactgaagcccagacctccgtgcccaggcccaatctcgtcaggctgccagagaaagttggtgctgctcatactggtctcacagtctaatacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaata

SEQ ID NO: 298460 - DNA, 2091 bp, Homo sapiens
ggccgccgggagccggggcccagcgcgtgcgcagacggagcgcgctgagcggagggggaggtggctgccgcttctcccgcgtccgccattttgttgctgtggctattgggaacaagctgggcaaaagcaccccggaggcgcgacgctccttcgagttcggtgcctcgtgtgacggcgggggtcggtgaagacccgtcgagctgcggcgccggcgcgttccaggccgggagtcactggaggcacccctgggacgccgagcagcccgagaaccccggggtggcctccgctgcggctcgggtttgcctgccccgaccccccggctctgccgtgcattcccgggcggctctctccgtgtggcggccccggagcaggcgggcggcgtcggaggatgctgcgggcccggagccgagaggaaagtgctggcccagccctctgagcgctcctcgaggtgtgcgagaggcccttcctcggccccaaagccgtctgccgggctaaggcgtgcagagcaggcgaggacagccgccgcccctaccgccgcagagtccccggtccaacaccatgtcctccgccaggttcgactcctcggaccgctccgcctggtatatggggccggtgtctcgccaggaggcgcagacccggctccagggccagcgccacggtatgttcctcgtccgcgattcttccacctgccctggggactatgtgctgtcggtgtccgagaactcgcgggtctcccactacatcatcaactcgctgcccaaccgccgttttaagatcggggaccaggaatttgaccatttgccggccctgctggagttttacaagatccactacctggacaccaccaccctcatcgagcctgcgcccaggtatccaagcccaccaatgggatctgtctcagcacccaacctgcctacagcagaagataacctggaatatgtacggactctgtatgattttcctgggaatgatgccgaagacctgccctttaaaaagggtgagatcctagtgataatagagaagcctgaagaacagtggtggagtgcccggaacaaggatggccgggttgggatgattcctgtcccttatgtcgaaaagcttgtgagatcctcaccacacggaaagcatggaaataggaattccaacagttatgggatcccagaacctgctcatgcatacgctcaacctcagaccacaactcctctacctgcagtttccggttctcctggggcagcaatcacccctttgccatccacacagaatggacctgtctttgcgaaagcaatccagaaaagagtaccctgtgcttatgacaagactgccttggcattagaggttggtgacatcgtgaaagtcacaaggatgaatataaatggccagtgggaaggcgaagtgaacgggcgcaaagggcttttcccctttacgcacgtcaaaatctttgaccctcaaaacccagatgaaaacgagtgattgctgttgccctgtttcctgctgctttgttgttctgcctgtcctagtctcctttgaagtgggaaagcattttctctcatagtacctaagactaatgctttctgtggacaccactgagctctgcctcaactccaccctctgcgaccggaggactatgcccctagtaactgctgtcggtgtggacgctgtgctggttctgttttctaaaggagcagaaggacaggtctctgagacaggatcgttgtccctacaggaggaacagtggccttgcttcttagacggtcttcactgtgtgttttaaaacaacaacaacaacaacaacaacataaaactcttttgacctgtaacttaaagatcataaacttcaggcaataatattttctgtgtaagcttttaaaattatttttggggatcatagcttgttttattttgtgctataaaattaacagtattaaatgacttatattcttagaatacatcgagtgtcttttcttaacagattagtgcctttttatttttgtattccgttttacgttactggtcccagcatcaaaacccttgtttccatggcctgtttgtatattgtctcaataaaacttgcatcagccggtggtggcggca

SEQ ID NO: 298461 - DNA, 1355 bp, Homo sapiens
agctggtagtcttgacgtgagctagctggcatggcggcctgcattgcagcggggcactgggctgcaatgggcctaggccggagtttccaagccgccaggactctgctccccccgccggcctctatcgcctgcagggtccacgcggggcctgtccggcagcagagcactgggccttccgagcccggtgcgttccaaccgccgccgaaaccggtcatcgtggacaagcaccgccccgtggaaccggaacgcaggttcttgagtcctgaattcattcctcgaaggggaagaacagatcctctgaaatttcaaatagaaagaaaagatatgttagaaaggagaaaagtactccacattccagagttctatgttggaagtattcttcgtgttactacagctgacccatatgccagtggaaaaatcagccagtttctggggatttgcattcagagatcaggaagaggacttggagctactttcatccttaggaatgttatcgaaggacaaggtgtcgagatttgctttgaactttataatcctcgggtccaggagattcaggtggtcaaattagagaaacggctggatgatagcttgctatacttacgagatgcccttcctgaatatagcacttttgatgtgaatatgaagccagtagtacaagagcctaaccaaaaagttcctgttaatgagctgaaagtaaaaatgaagcctaagccctggtctaaacgctgggaacgtccaaattttaatattaaaggaatcagatttgatctttgtttaactgaacagcaaatgaaagaagctcagaagtggaatcagccatggcttgaatttgatatgatgagggaatatgatacttcaaaaattgaagctgcaatatggaaggaaattgaagcgtcgaaaaggtcttgattctgagaatgaatttggttagttgcagaagatacattggctctaagaggatatattttgagaccaatttaatttcatttataagaacatagtaattaagtgaactaagcattcattgttttattaatactttttttctaaaataaaacttgtacaccagtttattactctaaaaagagaattacacatgccaaatggaccaatgtccatttgcttattggaggcaaagctacaatagaagtcagagcatcaccagaatggtctttaatgagcatggaacctgagcaaagggaataggtgggatgaattttttttttaattgtgaaacaattcataagcacaatatgatttacagaataataaacattcatgtacccactatcaggttaagaaatagaacatttattaatatgtaggaatgttaagaaataaaacatttaataaga

SEQ ID NO: 298462 - DNA, 709 bp, Homo sapiens
agctggtagtcttgacgtgagctagctggcatggcggcctgcattgcagcggggcactgggctgcaatgggcctaggccggagtttccaagccgccaggactctgctccccccgccggcctctatcgcctgcagggtccacgcggggcctgtccggcagcagagcactgggccttccgagcccggtgcgttccaaccgccgccgaaaccggtcatcgtggacaagcaccgccccgtggaaccggaacgcaggttcttgagtcctgaattcattcctcgaaggggaagaacagatcctctgaaatttcaaatagaaagaaaagatatgttagaaaggagaaaagtactccacattccagagttctatgttggaagtattcttcgtgttactacagctgacccatatgccagtggaaaaatcagccagtttctggggatttgcattcagagatcaggaagaggacttggagctactttcatccttaggaatgttatcgaaggacaagggccagtgtatattcataatcctgaaagatggctgcctgggccatgagaacacaaatcagatcactgaacagagaaaagtaccttcgagattcaatctcttctaaaatccactgagttttttcatctactgagaagtttccacttgtggatgtctcatctttgcctgttaataaataaaattgacttcatactacaaattctca

SEQ ID NO: 298463 - DNA, 4191 bp, Homo sapiens
agctggtagtcttgacgtgagctagctggcatggcggcctgcattgcagcggggcactgggctgcaatgggcctaggccggagtttccaagccgccaggactctgctccccccgccggcctctatcgcctgcagggtccacgcggggcctgtccggcagcagagcactgggccttccgagcccggtgcgttccaaccgccgccgaaaccggtcatcgtggacaagcaccgccccgtggaaccggaacgcaggttcttgagtcctgaattcattcctcgaaggggaagaacagatcctctgaaatttcaaatagaaagaaaagatatgttagaaaggagaaaagtactccacattccagagttctatgttggaagtattcttcgtgttactacagctgacccatatgccagtggaaaaatcagccagtttctggggatttgcattcagagatcaggaagaggacttggagctactttcatccttaggaatgttatcgaaggacaaggtgtcgagatttgctttgaactttataatcctcgggtccaggagattcaggtggtcaaattagagaaacggctggatgatagcttgctatacttacgagatgcccttcctgaatatagcacttttgatgtgaatatgaagccagtagtacaagagcctaaccaaaaagttcctgttaatgagctgaaagtaaaaatgaagcctaagccctggtctaaacgctgggaacgtccaaattttaatattaaaggaatcagatttgatctttgtttaactgaacagcaaatgaaagaagctcagaagtggaatcagccatggcttgaatttgatatgatgagggaatatgatacttcaaaaattgaagctgcaatatggaaggaaattgaagcgtcgaaaaggtcttgattctgagaatgaatttggttagttgcagaagatacattggctctaagaggatatattttgagaccaatttaatttcatttataagaacatagtaattaagtgaactaagcattcattgttttattaatactttttttctaaaataaaacttgtacaccagtttattactctaaaaagagaattacacatgccaaatggaccaatgtccatttgcttattggaggcaaagctacaatagaagtcagagcatcaccagaatggtctttaatgagcatggaacctgagcaaagggaataggtgggatgaattttttttttaattgtgaaacaattcataagcacaatatgatttacagaataataaacattcatgtacccactatcaggttaagaaatagaacatttattaatatgtaggaatgttaagaaataaaacatttaataagatctcagaagactccagtaaatctgcaattgtatctctctcctttttaaatgtaaatatcatcttgacttgttaattattcccttgcatttcttttagtttactgccaacacatatattcttcaacaatatatttaattttgaaaaacctgaaaaaaaaaacctgttagcaagtataaaggggcagtattactattattgcatgaaggcttcaagggaaacgttacagtctttgggtcatagtctggcttcagcttcctctgagagtttacagaggccaattttgagcaaattcatggctaaggttatgagtgagttctgctaaacagaaggctcaccacaaggtatctggcaggattatactgggtagctggatgttgcagaaatgtggttagaggaagtaaactgttttttgatgctcacagcatgatgaatcaaactctgtatcttaggattaggttaaaacaatacctttggtatgatatgagtgttgttgctgatccatgcagcatggattggaaagctggggtataagcacacatgctaaagaaaaacatgtaatttggtccatactcacctggatatactgttcctcaggttaaaaaatacagtactatcctaaatcttgaaggcaactctcagcctatccattgagttaccttcagatctgccctctggttcctagctgtcttgggactaacttctttcctgcgctcagctgttttctggattccatgttttccattttattgagtactaacttgttttgctgcagcacatcctttggtagcttctagaggaagtttgtgtggaggtaaaatttttgagaccttgcatgtctcatgtttgattgatactttatacgtttaggtaggaggtaattttccttcaggactttaaaaatattgttgctccattttctttgtttctattgttgtattgagaaatccaatgccattttgatttccccatcataaatttcatgatgatgtgtcttggtgtgggtctatatttatccattgcattgggttttaggtgaacccttccagatagtaactcatttctgtcagttctgggaaacacttagcattggttgatgatttattctctgctgctttgttctcccaactattatttggatgttggatatccagcactgggtatctattttcttacctccctcccttgaccccagtctctgttttttagctctttagctcaatcttccaactctttgctattgtattttaaaatcttaagaccccttcttgatttgtagaagttccttttcttacaaccaaaaagcctttatctatggatttgttcacagataaggggtattcaatatagtgtatttttttttcatttaaaattgtttgcgcatctatttcctccaaatttctttctgtatttattttttgttgtctatatttcagacttttccaggatatctgataatctttggctgtcttcttatggttgaaagagggactaaaaagcttggaaagcctttgggttgtgggaaggggctgtctttaggattatctgaatgggcttttttgggagtcccctcctccacatgaatattttggttttgtcagattccctagaatagaggcttccaatctccttcctggaggggtctgtccaggaaggagattgtctaggggtctgtcagacagcagctttcagctacttccttgatctttttcactaatgattatatagtcatctaactactgtcaacaagtaatagatatcctatccttcacttgtttagattatttgctgagataacctctcaaaagaacctctcaaaataaaaggttaacaagagcctatatcttatatttttcttctctttatcttgttagaagatagctattaaaacctgttctttttctgtcttgataaacacacttcaatcttggtagaatggtagatgggacagtatattttaggacctaaagctctgcaaatgtatgatcagcttgtaagtacaggtgctcaaaaacatgtaaacaatcatgctttttactctgtaggaatatctttaaaattcttgtgaatttttccccagaagtaaagcaaatcttcccccagaaataaaattaaatgtgcataatctaaagcttttttttcttattgtggtaggatatatatataaaacataatttgccattgtaaacattttaaatttacaagtcagaggcattaattacatcacaatgttgtgaaattattactactatttccaaaattttctcatcaccccaaactgaaactctgtaactgttgagcaataacctcattcctgtatctctcccaaccccaggtaacctcaaatctttctttttatctttgagacaaggtctcattctatcactcaggtaggagtgcagtggtgtgatcatagctcattgcagcctcaaaatcctgggctcaagcaatcctccttgagtagctaagactataggcacacattaactgcgcctggctgattttgttttttgtagagatgtggtcttgctatgtttcccatgctggtcttgagttcctggcctcaagcagtccttaagattcatccatgttgtggcatgtgtcagaatttcatttgtttttatgactaaataatattccattgtatgtatatacattttgttcatccatcttctgatgaacactgggatatgtctaccttttggctattgtgaataatgctgcagtaaacattgacataacaagtatgtatttgattaccaattcagttcccctcaatatcattttgaatttctcacctgttttaaatcaattcatttctacatgaagattatcagt

SEQ ID NO: 298464 - DNA, 1441 bp, Homo sapiens
ggcttccctcagagtgaagcaaaggaagtaagaactatcatagtcagtgcatttgtgtttttattttatttttttaaatttatttattttttcgagatggagtcttgctctgtcgcccaggctggcatgctagtggcgcgatctcggctcactgccacctccgcctcctaggttcaagtgattctcctgcctcagcctcctaagtagctgggattacaggggtccacgcggggcctgtccggcagcagagcactgggccttccgagcccggtgcgttccaaccgccgccgaaaccggtcatcgtggacaagcaccgccccgtggaaccggaacgcaggttcttgagtcctgaattcattcctcgaaggggaagaacagatcctctgaaatttcaaatagaaagaaaagatatgttagaaaggagaaaagtactccacattccagagttctatgttggaagtattcttcgtgttactacagctgacccatatgccagtggaaaaatcagccagtttctggggatttgcattcagagatcaggaagaggacttggagctactttcatccttaggaatgttatcgaaggacaaggtgtcgagatttgctttgaactttataatcctcgggtccaggagattcaggtggtcaaattagagaaacggctggatgatagcttgctatacttacgagatgcccttcctgaatatagcacttttgatgtgaatatgaagccagtagtacaagagcctaaccaaaaagttcctgttaatgagctgaaagtaaaaatgaagcctaagccctggtctaaacgctgggaacgtccaaattttaatattaaaggaatcagatttgatctttgtttaactgaacagcaaatgaaagaagctcagaagtggaatcagccatggcttgaatttgatatgatgagggaatatgatacttcaaaaattgaagctgcaatatggaaggaaattgaagcgtcgaaaaggtcttgattctgagaatgaatttggttagttgcagaagatacattggctctaagaggatatattttgagaccaatttaatttcatttataagaacatagtaattaagtgaactaagcattcattgttttattaatactttttttctaaaataaaacttgtacaccagtttattactctaaaaagagaattacacatgccaaatggaccaatgtccatttgcttattggaggcaaagctacaatagaagtcagagcatcaccagaatggtctttaatgagcatggaacctgagcaaagggaataggtgggatgaattttttttttaattgtgaaacaattcataagcacaatatgatttacagaataataaacattcatgtacccactatcaggttaagaaatagaacatttattaatatgtaggaatgttaagaaataaaacatttaataaga

SEQ ID NO: 298465 - DNA, 1301 bp, Homo sapiens
agctggtagtcttgacgtgagctagctggcatggcggcctgcattgcagcggggcactgggctgcaatgggcctaggccggagtttccaagccgccaggactctgctccccccgccggcctctatcgcctgcagggtccacgcggggcctgtccggcagcagagcactgggccttccgagcccggtgcgttccaaccgccgccgaaaccggtcatcgtggacaagcaccgccccgtggaaccggaacgcaggttcttgagtcctgaattcattcctcgaaggggaagaacagatcctctgaaatttcaaatagaaagaaaagatatgttagaaaggagaaaagtactccacattccagagttctatgttggaagtattcttcgtgttactacagctgacccatatgccattggagctactttcatccttaggaatgttatcgaaggacaaggtgtcgagatttgctttgaactttataatcctcgggtccaggagattcaggtggtcaaattagagaaacggctggatgatagcttgctatacttacgagatgcccttcctgaatatagcacttttgatgtgaatatgaagccagtagtacaagagcctaaccaaaaagttcctgttaatgagctgaaagtaaaaatgaagcctaagccctggtctaaacgctgggaacgtccaaattttaatattaaaggaatcagatttgatctttgtttaactgaacagcaaatgaaagaagctcagaagtggaatcagccatggcttgaatttgatatgatgagggaatatgatacttcaaaaattgaagctgcaatatggaaggaaattgaagcgtcgaaaaggtcttgattctgagaatgaatttggttagttgcagaagatacattggctctaagaggatatattttgagaccaatttaatttcatttataagaacatagtaattaagtgaactaagcattcattgttttattaatactttttttctaaaataaaacttgtacaccagtttattactctaaaaagagaattacacatgccaaatggaccaatgtccatttgcttattggaggcaaagctacaatagaagtcagagcatcaccagaatggtctttaatgagcatggaacctgagcaaagggaataggtgggatgaattttttttttaattgtgaaacaattcataagcacaatatgatttacagaataataaacattcatgtacccactatcaggttaagaaatagaacatttattaatatgtaggaatgttaagaaataaaacatttaataaga

SEQ ID NO: 298466 - DNA, 898 bp, Homo sapiens
gcgcgccagtttcaggatgcagggtctagggaggagctgcaatcgtgtctggggccccagcccaggctggccggagctcctgtttccgctgctctgctgcctgcccggggtaccaacatggcccagaagcgtcctgcctgcaccctgaagcctgagtgtgtccagcagctgctggtttgctcccaggaggccaagaagtcagcctactgcccctacagtcactttcctgtgggggctgccctgctcacccaggaggggagaatcttcaaagggtgcaacatagaaaatgcctgctacccgctgggcatctgtgctgaacggaccgctatccagaaggccgtctcagaagggtacaaggatttcagggcaattgctatcgccagtgacatgcaagatgattttatctctccatgtggggcctgcaggcaagtcatgagagagtttggcaccaactggcccgtgtacatgaccaagccggatggtacgtatattgtcatgacggtccaggagctgctgccctcctcctttgggcctgaggacctgcagaagacccagtgacagccagagaatgcccactgcctgtaacagccacctggagaacttcataaagatgtctcacagccctggggacacctgcccagtgggccccagccctacagggactgggcaaagatgatgtttccagattacactccagcctgagtcagcacccctcctagcaacctgccttgggacttagaacaccgccgccccctgccccacctttcctttccttcctgtgggccctctttcaaagtccagcctagtctggactgcttccccatcagccttcccaaggttctatcctgttccgagcaacttttctaattataaacatcacagaacatcctggatcaaa

SEQ ID NO: 298467 - DNA, 961 bp, Homo sapiens
gtccaaaccatgggaggctcctctcctagaccctgcatcctgaaagctgcgtacctgagagcctgcggtctggctgcagggacacacccaggggaggagctgcaatcgtgtctggggccccagcccaggctggccggagctcctgtttccgctgctctgctgcctgcccggggtaccaacatggcccagaagcgtcctgcctgcaccctgaagcctgagtgtgtccagcagctgctggtttgctcccaggaggccaagaagtcagcctactgcccctacagtcactttcctgtgggggctgccctgctcacccaggaggggagaatcttcaaagggtgcaacatagaaaatgcctgctacccgctgggcatctgtgctgaacggaccgctatccagaaggccgtctcagaagggtacaaggatttcagggcaattgctatcgccagtgacatgcaagatgattttatctctccatgtggggcctgcaggcaagtcatgagagagtttggcaccaactggcccgtgtacatgaccaagccggatggtacgtatattgtcatgacggtccaggagctgctgccctcctcctttgggcctgaggacctgcagaagacccagtgacagccagagaatgcccactgcctgtaacagccacctggagaacttcataaagatgtctcacagccctggggacacctgcccagtgggccccagccctacagggactgggcaaagatgatgtttccagattacactccagcctgagtcagcacccctcctagcaacctgccttgggacttagaacaccgccgccccctgccccacctttcctttccttcctgtgggccctctttcaaagtccagcctagtctggactgcttccccatcagccttcccaaggttctatcctgttccgagcaacttttctaattataaacatcacagaacatcctggatcaaa

SEQ ID NO: 298468 - DNA, 1069 bp, Homo sapiens
gtccaaaccatgggaggctcctctcctagaccctgcatcctgaaagctgcgtacctgagagcctgcggtctggctgcagggacacacccaggggaggagctgcaatcgtgtctggggccccagcccaggctggccggagctcctgtttccgctgctctgctgcctgcccggggtaccaacatggcccagaagcgtcctgcctgcaccctgaagcctgagtgtgtccagcagctgctggtttgctcccaggaggccaagaagtcagcctactgcccctacagtcactttcctgtgggggctgccctgctcacccaggaggggagaatcttcaaagggtgcaacatagaaaatgcctgctacccgctgggcatctgtgctgaacggaccgctatccagaaggccgtctcagaagggtacaaggatttcagggcaattgctatcgccagtgacatgcaagatgattttatctctccatgtggggcctgcaggcaagtcatgagagagtttggcaccaactggcccgtgtacatgaccaagccggatggtacgtatattgtcatgacggtccaggagctgctgccctcctcctttgggcctgaggacctgcagaagacccagtgacagccagagaatgcccactgcctgtaacagccacctggagaacttcataaagatgtctcacagccctggggacacctgcccagtgggccccagccctacagggactgggcaaagatgatgtttccagattacactccagcctgagtcagcacccctcctagcaacctgccttgggacttagaacaccgccgccccctgccccacctttcctttccttcctgtgggccctctttcaaagtccagcctagtctggactgcttccccatcagccttcccaaggttctatcctgttccgagcaacttttctaattataaacatcacagaacatcctggatcaaaaaaaaaggggggggtcaaaattcctcgaggggcagtacggtccgttttgaaagggccatggggggtaaaagggggggtaaagggggaaaggcgggttgggaccctggg

SEQ ID NO: 298469 - DNA, 1082 bp, Homo sapiens
gtccaaaccatgggaggctcctctcctagaccctgcatcctgaaagctgcgtacctgagagcctgcggtctggctgcagggacacacccaggggaggagctgcaatcgtgtctggggccccagcccaggctggccggagctcctgtttccgctgctctgctgcctgcccggggtaccaacatggcccagaagcgtcctgcctgcaccctgaagcctgagtgtgtccagcagctgctggtttgctcccaggaggccaagaagtcagcctactgcccctacagtcactttcctgtgggggctgccctgctcacccaggaggggagaatcttcaaaggcagggtctctctgctgcccatgctggaagtacagtggcgcgagcctagttcactgcagtctcaaacccctgagttcaagctatcctcctgtcttagcctcccaagtagctgggactacagggtgcaacatagaaaatgcctgctacccgctgggcatctgtgctgaacggaccgctatccagaaggccgtctcagaagggtacaaggatttcagggcaattgctatcgccagtgacatgcaagatgattttatctctccatgtggggcctgcaggcaagtcatgagagagtttggcaccaactggcccgtgtacatgaccaagccggatggtacgtatattgtcatgacggtccaggagctgctgccctcctcctttgggcctgaggacctgcagaagacccagtgacagccagagaatgcccactgcctgtaacagccacctggagaacttcataaagatgtctcacagccctggggacacctgcccagtgggccccagccctacagggactgggcaaagatgatgtttccagattacactccagcctgagtcagcacccctcctagcaacctgccttgggacttagaacaccgccgccccctgccccacctttcctttccttcctgtgggccctctttcaaagtccagcctagtctggactgcttccccatcagccttcccaaggttctatcctgttccgagcaacttttctaattataaacatcacagaacatcctggatcaaa

SEQ ID NO: 298470 - DNA, 836 bp, Homo sapiens
gcgcgccagtttcaggatgcagggtctagggaggagctgcaatcgtgtctggggccccagcccaggctggccggagctcctgtttccgctgctctgctgcctgcccggggtaccaacatggcccagaagcgtcctgcctgcaccctgaagcctgagtgtgtccagcagctgctggtttgctcccaggaggccaagaagtcagcctactgcccctacagtcactttcctgtgggggctgccctgctcacccaggaggggagaatcttcaaagaaggccgtctcagaagggtacaaggatttcagggcaattgctatcgccagtgacatgcaagatgattttatctctccatgtggggcctgcaggcaagtcatgagagagtttggcaccaactggcccgtgtacatgaccaagccggatggtacgtatattgtcatgacggtccaggagctgctgccctcctcctttgggcctgaggacctgcagaagacccagtgacagccagagaatgcccactgcctgtaacagccacctggagaacttcataaagatgtctcacagccctggggacacctgcccagtgggccccagccctacagggactgggcaaagatgatgtttccagattacactccagcctgagtcagcacccctcctagcaacctgccttgggacttagaacaccgccgccccctgccccacctttcctttccttcctgtgggccctctttcaaagtccagcctagtctggactgcttccccatcagccttcccaaggttctatcctgttccgagcaacttttctaattataaacatcacagaacatcctggatcaaa

SEQ ID NO: 298471 - DNA, 588 bp, Homo sapiens
  misc_feature (39)..(39): n is a, c, g, or t
cagaggcaccaaggagcgcagaggcaccaaggagccagnaggcaccaaggagggtacaaggatttcagggcaatgacatgcaagatgattttatctctccatgtggggcctgcaggcaagtcatgagagagtttggcaccaactggcccgtgtacatgaccaagccggatggtacgtatattgtcatgacggtccaggagctgctgccctcctcctttgggcctgaggacctgcagaagacccagtgacagccagagaatgcccactgcctgtaacagccacctggagaacttcataaagatgtctcacagccctggggacacctgcccagtgggccccagccctacagggactgggcaaagatgatgtttccagattacactccagcctgagtcagcacccctcctagcaacctgccttgggacttagaacaccgccgccccctgccccacctttcctttccttcctgtgggccctctttcaaagtccagcctagtctggactgcttccccatcagccttcccaaggttctatcctgttccgagcaacttttctaattataaacatcacagaacatcctggatcaaa

SEQ ID NO: 298472 - DNA, 840 bp, Homo sapiens
gcgcgccagtttcaggatgcagggtctagggaggagctgcaatcgtgtctggggccccagcccaggctggccggagctcctgtttccgctgctctgctgcctgcccggggtaccaacatggcccagaagcgtcctgcctgcaccctgaagcctgagtgtgtccagcagctgctggtttgctcccaggaggccaagaagtcagcctactgcccctacagtcactttcctgtgggggctgccctgctcacccaggaggggagaatcttcaaagggtgcaacatagaaaatgcctgctacccgctgggcatctgtgctgaacggaccgctatccagaaggccgtctcagaagggtacaaggatttcagggcaattgctatcgccagtttggcaccaactggcccgtgtacatgaccaagccggatggtacgtatattgtcatgacggtccaggagctgctgccctcctcctttgggcctgaggacctgcagaagacccagtgacagccagagaatgcccactgcctgtaacagccacctggagaacttcataaagatgtctcacagccctggggacacctgcccagtgggccccagccctacagggactgggcaaagatgatgtttccagattacactccagcctgagtcagcacccctcctagcaacctgccttgggacttagaacaccgccgccccctgccccacctttcctttccttcctgtgggccctctttcaaagtccagcctagtctggactgcttccccatcagccttcccaaggttctatcctgttccgagcaacttttctaattataaacatcacagaacatcctggatcaaa

SEQ ID NO: 298473 - DNA, 510 bp, Homo sapiens
  misc_feature (27)..(27): n is a, c, g, or t
cggagtgaagagggaaggtgtaagggnaagaacagacaacgctatcttggacctttggcaccaactggcccgtgtacatgaccaagccggatggtacgtatattgtcatgacggtccaggagctgctgccctcctcctttgggcctgaggacctgcagaagacccagtgacagccagagaatgcccactgcctgtaacagccacctggagaacttcataaagatgtctcacagccctggggacacctgcccagtgggccccagccctacagggactgggcaaagatgatgtttccagattacactccagcctgagtcagcacccctcctagcaacctgccttgggacttagaacaccgccgccccctgccccacctttcctttccttcctgtgggccctctttcaaagtccagcctagtctggactgcttccccatcagccttcccaaggttctatcctgttccgagcaacttttctaattataaacatcacagaacatcctggatcaaa

SEQ ID NO: 298474 - DNA, 558 bp, Homo sapiens
gcatccccagtaagcagggccctgcgtggcaggcaccacattggacaatcccacaggctttcccactagtgcagtgggccggtgacccaatcctgtttaatgaggtctggatctccggcccttgggagccaccgcattcctggatttgctccctccttggtgcctcttggctgctgccctcctcctttgggcctgaggacctgcagaagacccagtgacagccagagaatgcccactgcctgtaacagccacctggagaacttcataaagatgtctcacagccctggggacacctgcccagtgggccccagccctacagggactgggcaaagatgatgtttccagattacactccagcctgagtcagcacccctcctagcaacctgccttgggacttagaacaccgccgccccctgccccacctttcctttccttcctgtgggccctctttcaaagtccagcctagtctggactgcttccccatcagccttcccaaggttctatcctgttccgagcaacttttctaattataaacatcacagaacatcctggatcaaa

SEQ ID NO: 298475 - DNA, 385 bp, Homo sapiens
ccttgggagagactaatttgagtttgattctttgcttccctgacatgcaagatgattttatctctccatgtggggcctgcaggcaagtcatgagagaggtaagcagcttctcttgctgtctggaatgcaaatatcttccctgtcgcaggctatgggagccacgccaagttgcaggcatggcaggcatggcaggcgtggagacacagctactgtcctgtttgcttggttggctgacttctaaggcctccctacgcttgcatgagtcactggaaattattccttcatttaacaaatacttaccgagtgagtgtctgctttgtgccaggccctgaggtagctctggggaggcacagggaaaagatgggccaggccctgccctcacaga

SEQ ID NO: 298476 - DNA, 1011 bp, Homo sapiens
cgctacggctagtacgaggctgggtgttgagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgctcaacaatgtgccaaggttcaccgagtcttctcaaaatggtactcgggggtcaaatccgcgacccatggggttagggggatatggcaaggccttgccctgttgagtcggggtgctggcccagctgtctttgcccttgtttcacatc

SEQ ID NO: 298477 - DNA, 3239 bp, Homo sapiens
agaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298478 - DNA, 3548 bp, Homo sapiens
  misc_feature (3548)..(3548): n is a, c, g, or t
agaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctccccaaaaaacaaaaataaaagaaacaacaagacacaccacaaaacacaaacgaacaaaaaaaaagtacaggcgagcgacaattatcagagcggcggcgcgtcacaaaaagacagagtgataacaaaaagacgaggcaacgacgagggacaccacgcaggtgacaacacgacaaccaccaggacgttactagcggtacaacaagacggtggagcagaacacctcggaggcccccaccaataaagtggagagcacacaaaagaccaacacgaaagccgaccggggaaccccgccaaataaaaatcactgaggaan

SEQ ID NO: 298479 - DNA, 3965 bp, Homo sapiens
agaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctccccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggacacaaaaaagcataaaccacaacagaacgaaagaacaaagacgaacgacactgcccgcgacgacagcacgaacatagacaggtcgagagatagaagagcaagcaaggcgccggaagcaaaacaagcgccaccgcgcatagccaaccgcagaacacgcgacaataatacgacagcatcatgatggctcagacaagagagacgaacgagaatgaagcgccagccgcgcccgcggcagagaaactcgtagccgaagagagtcgccacaacagagatcgacgagtaggacgacgcaacactcaaccgcatgtacacgcacggagaaggaacgatacgacgacaaacacaacacagcaacaagaaactaccggacccaccacccagcggcagacggaaagaaggcagcccgcacgccacgaaacgaagacaagcacgaagacaggaagagacacaaaaaaaatgggagagaaaaccgcgcagaggtactcagacacacccggacacactgcaggagaaggtaccacacaaccaacacggaccaagacaccagagagcagacaaagcaacaaaggagcgtgcggataccccgaaggaatgcacgccaccagcggaacacgctcc

SEQ ID NO: 298480 - DNA, 3142 bp, Homo sapiens
agaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttcgtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298481 - DNA, 3371 bp, Homo sapiens
agaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcaggtgtggggcagtgggggcctggggagatgatgatggacacatagagtttgattagctgccatagctcaaggcttcttgcattaactcaccacaagcccttttggtcttttgtggataccgtttttcccttagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298482 - DNA, 3177 bp, Homo sapiens
cgctacggctagtacgaggctgggtgttgagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298483 - DNA, 3430 bp, Homo sapiens
agaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactgtatgtgccaggctgtgggtggggcctgccctgggggttctgggcaggggggcgatcaggaccttcccagtgagtgactagggatgtgagccagtggtgaggttatcgtggtgggaggagtgacaagagtgaatctggacacttctgagaggcaggaagggtaggcgaggataactctccttccctttcagacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298484 - DNA, 3321 bp, Homo sapiens
agaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccggtcaggggccagggagaggatggctgggggaaggcagggaaaggagggggtgtaccagtattaaccctctccccacccacagggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298485 - DNA, 3512 bp, Homo sapiens
agaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccggtcaggggccagggagaggatggctgggggaaggcagggaaaggagggggtgtaccagtattaaccctctccccacccacagggacctggacttctctgagtttgtcatccagccacagaatgagtcgaatccggagctgtacaaatatgacctcatcgcggtttccaaccattatgggggcatgcgtgatggacactgtatgtgccaggctgtgggtggggcctgccctgggggttctgggcaggggggcgatcaggaccttcccagtgagtgactagggatgtgagccagtggtgaggttatcgtggtgggaggagtgacaagagtgaatctggacacttctgagaggcaggaagggtaggcgaggataactctccttccctttcagacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298486 - DNA, 2868 bp, Homo sapiens
  misc_feature (2868)..(2868): n is a, c, g, or t
agaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccactaacctgaggtactgagcggtccttgtgctgtgtggtgtgcggtggtgggtgtggn

SEQ ID NO: 298487 - DNA, 2368 bp, Homo sapiens
agaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtgaggggccagagcggggc

SEQ ID NO: 298488 - DNA, 2591 bp, Homo sapiens
agaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298489 - DNA, 3059 bp, Homo sapiens
gatgagaccagtttcggtcctggaggtggggccgggcctgcgtagtgaaactgcgtaggaacctgggaagaaggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298490 - DNA, 3410 bp, Homo sapiens
agaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaaggtacaaggcctttgcctccttctcaccctagccctggagttcttgtcccttccgtccctacagatgatcataagcccattctgtgtgctaggtcactggtggggtggccagagtcattcgtcagtttcctttgttgattcttcctctgccacctccacccccgccccacagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298491 - DNA, 3100 bp, Homo sapiens
gaggggaggtggtgcctatgaggcagaaaatggcgcctgcgaataagcaaagtttatgacgcgccgtggtttttgattctggcggaagccttcccgagtcgagagaacgtgcaggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298492 - DNA, 3547 bp, Homo sapiens
agaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtataatggatggggagggtgcatggcggggagtgcgtagtaagaaagccttgtaggcccagcatgggtacagatccatgtatgctgggtaggtacacatatgtctgctctcttccccctcctagctcatcatacaggtatctttgtctgctgtgtgtgttcccctgtgtggctctctttacagaccattgtatatgtgtgtttgtatgctatgtttgtaaggcagagtgtgtgctcctctcatttgagaggtcacagcgctgtgtctgtgtgagtacacctgtgtctgcacccctctactcttacaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298493 - DNA, 3139 bp, Homo sapiens
tgtatgcgaagtacgtgcgcgtgtgcgcgtgaggtctactgtgatgatagccacagcacaaatgagtcttcacggctggaacgaatcagtgtccgccacatagatcctggagagactggccgaaaacgtgcactgcctggccggggacggctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298494 - DNA, 3156 bp, Homo sapiens
agaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298495 - DNA, 1735 bp, Homo sapiens
  misc_feature (1696)..(1696): n is a, c, g, or t
  misc_feature (1700)..(1700): n is a, c, g, or t
  misc_feature (1704)..(1704): n is a, c, g, or t
  misc_feature (1716)..(1716): n is a, c, g, or t
  misc_feature (1719)..(1719): n is a, c, g, or t
  misc_feature (1732)..(1732): n is a, c, g, or t
  misc_feature (1734)..(1734): n is a, c, g, or t
agaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcagctcgcattgagtccattgagnactngagngagtcaacctgntantgacaaaagaggngng

SEQ ID NO: 298496 - DNA, 3057 bp, Homo sapiens
cgcgtgccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttcccctgtgtggctctctttacagaccattgtatatgtgtgtttgtatgctatgtttgtaaggcagagtgtgtgctcctctcatttgagaggtcacagcgctgtgtctgtgtgagtacacctgtgtctgcacccctctactcttacaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298497 - DNA, 1552 bp, Homo sapiens
agaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggcctagtattgcgcacagctcgggagcggtttctggtggagccccaggaagacactcggctttgggccaagaactcagaaggctctttggataggttgtatgacacacacatcacggttctcgatgcggcccttgagactgggcagttgatcatcatggagacccgcaagaaaagatggcacttggcccagcgcacagctgcatgtcatgaacaacaacatgtcggaagaggatgaggacttcaagggtcagccaggcatctgtggcctcaccaatctgggcaacacgtgcttcatgaactcggccctgcagtgcctcagcaatgtgccacagctcaccgagtacttcctcaacaactgctacctggaggagctcaacttccgcaacccactgggcatgaagggtgagatcgcagaggcctatgcagacctggtgaagcaggcgtggtctggccaccaccgctccattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagacgggtctggtccaaaaaggaactcggttattgtggcctggcaacacggctcccaaggaaggggggttac

SEQ ID NO: 298498 - DNA, 2188 bp, Homo sapiens
tgtcggtccaatgattgtccacgctcattgtgccacatgtgttcaagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298499 - DNA, 2228 bp, Homo sapiens
tgactcaaccctgggcacccccgaccccctacgtctcttggctctcctaactccctctctctctgatgaccctgcccatcttcttagaacaaggttggccattttgcatcccaatttctgggctaccagcagcatgactctcaggagctgctgtcattcctcctggacgggctgcatgaggaccttaatcgggtgaagaagaaggagtatgtggagctgtgcgatgctgctgggcgaccggatcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298500 - DNA, 2042 bp, Homo sapiens
actgcgacttttctaggcaacgccggtttatcgtttgtctgcggggagaaccgcggtcaggaggtggcacaggaggcatggcaaaaccacaaacggcggaacgattctgtgatcgtggacactttccacggcctcttcaagtccacgctggtgtgccccgattgtggcaatgtatctgtgaccttcgaccccttctgctacctcagtgttccactgcctatcagccacaagagggtcttggaggtcttctttatccccatggatccgcgccgcaagccagagcagcaccggctcgtggtccccaagaaaggcaagatctcggatctatgtgtggctctgtccaaacacacgggcatctcgccagagaggatgatggtggctgatgtcttcagtcaccgcttctataagctctatcagctagaggagcctctgagcagcatcttggaccgtgatgatatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298501 - DNA, 2039 bp, Homo sapiens
agaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298502 - DNA, 1649 bp, Homo sapiens
ggcacgagggctgctcagaggctcctctagctgatagagcttatagaagcggtgactgaagacatcttcgtctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298503 - DNA, 1663 bp, Homo sapiens
gatcgtgcccgaattcgttgtgctcgtgccggaatttctcgtcgtcgtgccggaattcgtcgtcgtgccggaattcgtcgtcgtgctatgaggtgtcaggtcgcattgaggccattgagggctcaagagaggacatcgtggttcctgtctacctgcgggagcgcacccctgcccgtgactacaacaactcctactacggcctgatgctttttggacaccccctcctggtatcagtgccccgggaccgcttcacctgggagggcctgtataacgtcctgatgtaccggctctcacgctacgtgaccaaacccaactcagatgatgaggacgatggggatgagaaagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298504 - DNA, 1882 bp, Homo sapiens
agatggagtcttgctctgttgcccaggctggagtgtagtgacatgatcttggctcactgcaacctccatctcccggattcaagcgattctcctgcctcagcctcccaaatagctgcaattacagccgcgcgccaccacgcccagctaatcacactccacacctctgactgggacacaagttccttcattctcaggccactgctgacagccttggcctcttcatgcatttacgcgtcaccccttcagccctctcacacctcagattcagaacggtttacatgtggatctaccaatggcttcccattatcttaagtaaaatcccgggctctatccccactgtccttgtacccgtcttgggagtctcctctgctctgttgcagacgctacgtgaccaaacccaactcagatgatgaggacgatggggatgagaaaggtgagggggctaacagtcagtgggcgggggctctgggttaggtctgacccacgtagggttcgtctaggtgtgcattgcagcttagcacttgaggctcacaccttcccatctctgacatcctcctgtcctagaagatgacgaggaggataaagatgacgtccctgggccctcaactgggggcagcctccgagaccctgagccagagcaggctgggcccagctctggagtcacgaacaggtgcccgttcctcctggacaattgccttggcacatctcagtggcccccaaggcgacgacgcaagcagctgttcaccctgcagacggtgaactccaatgggaccagcgaccgcacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298505 - DNA, 1213 bp, Homo sapiens
  misc_feature (59)..(59): n is a, c, g, or t
  misc_feature (63)..(64): n is a, c, g, or t
aacactgcagctggctcagtgccgaaactgaatgttaagacaggtgtggctgagcgcantggnngcctaggtatatacatcaccttcaggtaagtaatttcaagtttgcagtgacaacctcccctgaagaagtccatgcccagccgtacattgctatcgactgggagccagagatgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298506 - DNA, 1090 bp, Homo sapiens
ctgtggcaggacccagggctctcaattaacatccatgaactcagagctgggtgaagaagcgttactatgacgaggtagaggctgagggctacgtgaagcatgactgcgtcgggtacgtgatgaagaaggctcccgtgcggctgcaggagtgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298507 - DNA, 1122 bp, Homo sapiens
ctactgatggccgcgagacagtttcgagactggacagactgtgcattacaagctgtttaagaaggcgggagaggccgggcgcggtggctcacgcctgtaatcccagcactttgggaggctgaagcaggcagatcacgaggtcaggagatggagaccatcctggctaacacggtgaaacccctgcattgagctcttcaccactgtggagaccctggagaaggaaaacccctggtactgcccttcctgcaagcagcaccagctggcaaccaagaagctggacctgtggatgctgccggagattctcatcatccacctgaaacgcttttcctacaccaagttctcccgagagaagctggacaccctcgtggagtttcctatccgggacctggacttctctgagtttgtcatccagccacagaatgagtcgaatccggagctgtacaaatatgacctcatcgcggtttccaaccattatgggggcatgcgtgatggacactacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298508 - DNA, 672 bp, Homo sapiens
agaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtactgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298509 - DNA, 901 bp, Homo sapiens
ctccttctccgacatcctctccctctccctcacctccctctccgacatcctctccctctccgacatcctctccctctccgacatcgtatgtgccaggctgtgggtggggcctgccctgggggttctgggcaggggggcgatcaggaccttcccagtgagtgactagggatgtgagccagtggtgaggttatcgtggtgggaggagtgacaagagtgaatctggacacttctgagaggcaggaagggtaggcgaggataactctccttccctttcagacacaacatttgcctgcaacaaggacagcggccagtggcactactttgatgacaacagcgtctcccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298510 - DNA, 592 bp, Homo sapiens
tacgggctatcgtcgaccacgccgtcggtctccctgtcaatgagaatcagatcgagtccaaggcagcctatgtcctcttctaccaacgccaggacgtggcgcgacgcctgctgtccccggccggctcatctggcgccccagcctcccctgcctgcagctccccacccagctctgagttcatggatgttaattgagagccctgggtcctgccacagaaaaaaaaaaaaaaaagccctctctgcaatctcgcttctcgtgtccgccccgcttctcttattcgtgttaggtgcccccgccaggcattgcaggcttagtcgtggctactgttctcctgtgccgctgcatcgctctctcccgggaaagaacaggtcgtgtctcctcctagcagtgcgcgccccgcctgtgtttgcccttccagcagtgaccctcccttctagtctttatttatggtcgtgcccttccctctcctcagcccagagtgttctgcgtgggtggtgatgggggttcacctgaacacagagtgtattttcttattgaggccctgtaccttctgctgtgtgtgtgtatatataaagcaccagtctgctcccca

SEQ ID NO: 298511 - DNA, 808 bp, Homo sapiens
agaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagatagaaaacggcgagagtgggcgagaacgtccactgcgggccggcgaaagctggttccttgtggagaagcactggtataagcagtgggaggcatacgtgcagggaggggaccaggactccagcaccttccctggctgcatcaacaatgccacactctttcaaggtacaaggcctttgcctccttctcaccctagccctggagttcttgtcccttccgtccctacagatgatcataagcccattctgtgtgctaggtcactggtggggtggccagagtcattcgtcagtttcctttgttgattcttcctctgccacctccacccccgccccacagatgagataaactggcgcctcaaggagggactggtggaaggcgaggattatgtgctgctcccagcagctgcttggcattacctggtcagctggtatggtctagagcatggccagccacccattgaacgcaaggtcatagagctgcccaacatccagaaggtcgaagtgtacccagtagaactgctgcttgtccggcacaatgatttgggcaaatctcacactgttcagttcagccataccgattctattggtgagtctaagggtcacgcaatggg

SEQ ID NO: 298512 - DNA, 284 bp, Homo sapiens
gtgcttcatgaactcggccctgcaggttgggccattatagttgtgtctggcacagccacgtggttgggcttcaagagctgaggattggggacagagctggggtcctgaggggactacagggcaaggggtcaggatgaaagctgaggccccacaagtctgaagtggcacgcccacgttcattcctgaactatcagcctcttctctcagcttgccctcattttccctcttctcttccctgttcccacgttcttccttctcgtgaaatcctaatgccttctctcccc

SEQ ID NO: 298513 - DNA, 255 bp, Homo sapiens
tgggaggagtgacaagagtgaatctggacacttctgagaggcaggaagggtaggcgaggataactctccttccctttcagacacaacatttgcctgcaacaaggacagcggccagtggcactactttgatgacaacagcgtctcccctgtcaatgagaatcagatcgaggtgtgacttccatcctacctcctccccttcttcctttctgattccacctccccacccccacaatccacactgactcctgtcctctc

SEQ ID NO: 298514 - DNA, 1022 bp, Homo sapiens
  misc_feature (877)..(877): n is a, c, g, or t
gaggtgaggccggactgaggctcttacagtggtccctgctggcccttggtgacgggtcgcgtcagttccgacccggacccgtacgctgctgcgctgacgtggctcccggaagtagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgagttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatctttggttgggacttattgcctgtccagtactgtgggtgatatttgcctttagtgcactcttctccttcagagtaaagtggttggcggtggttatcatgggtgtggtgctacaaggtgccaacctgtatggttacatcaggtgtaaggtgcgcagcagaaagcatttaaccagcatggctacttcatattttggaaagcagtttttaagacaaacactggagatgatcagacttcctgaatagagaaagcttatgtgcttgttacattggggaacactgaagagattcttgatcaaccttttagagcttagcccatgtgcacgaggagggtggcttgtttttccacttaaaactttttttacacggnaggttcaataagttattccttcccacggctcaattggggcaaccctccacttcggggtgcaccccgttaccgtgacatcacatgaggctataggacctcgcacagcgtttccactatatcggtgagcgccgacttgcgcaatttc

SEQ ID NO: 298515 - DNA, 1568 bp, Homo sapiens
gaggtgaggccggactgaggctcttacagtggtccctgctggcccttggtgacgggtcgcgtcagttccgacccggacccgtacgctgctgcgctgacgtggctcccggaagtagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgagttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatctttggttgggacttattgcctgtccagtactgtgggtgatatttgcctttagtgcactcttctccttcagagtaaagtggttgagacggtctcgccacattgcccagactggtctgaaagtcttgggctcaagagatcctcccgcttccgccttccaaagcgctgggataacaggcgtgagccgctgcccgggccatccctcgaggaagtttcatcaggtagacattaattctttcacgaggatcacggatcgagctctttactggaaacctgcgccccgccttagttctccacctcttcgtgcggctccaggcaactgccaacagatggcgcccgcccgcctatttctctccttgcggctttgggcctggaggggaggtggggagagtcccaatagcagaggaactggtgagcccgggccaaaatttcatctggcatccggaatgcattaaaaacaacccacaaatctgaagctcctcgcaggagagagagagagagagagagaggagagagaggagagaggagagagggagggaagagagtgacggagaaggagagaaagagacgggagagaggagagagaaagagagagagaggagagagagaaagaacgaacgaacagggaacttgtaaaactaaggggaaaagggcagaagagaggcagcagcgtggtccctgcaagcgtccgctttcctggccaagcagcccccagcacgcctgctttgtggggcagggccatgcggccccgaggaaggatgcggtgagccagagggttccagacaaaggaggggatccccaaggctctgggccagccagtccctgttttactggcaccacggtccctcctaggcgaggacgaagagggaaggggtggagacctccaccttctctgcgtgtggctgcgtccctttacagaatgacaggcccttacttccgagggcggggactaatgtgtaaggcttaacagatccaattccagaaattatctgtgtttttttcaatcaccctcttgtgcccccccaccccccattaaatttcatcttttatctttttttgg

SEQ ID NO: 298516 - DNA, 653 bp, Homo sapiens
tatagccccatggctgccttcattaccactacctcttcagtgttgagaacacacatgcgttgaatgtgtaatcagtatataactgtgggtctgtgtggcctgggctgtgcatgatgctgactcaaataaacagcggttttattggaccctctccttcttccagaagaagatcaatggaaagtaccttccaagttttggtccctcaagaagcccctgaaggtcagagggaggggaggaaaataccttcttgatgcaccagaaatcaccttataaacctcatcctccgtggagcacagtggctcacacctgtaatctcagcactttgggaggctgaggagagaggatcatttgaggctaggggtttgagaccaagctgggccaaatagtgagaccttgtctctacaaaaaaattttaaaaatgtgctgggcatggtggtgcgtgcctgtagtcccagcttgagcccaggaagttgtggcttcagtgagctgtgatcaccccactgcactctagcctgggccaaagcacgagaccctgtctcttaaaaaaaaattgtctttattaaaatgattctcagtatccttcatgctactgcagctgatttccaaagctgcctcatcttccgcgctctcaactcttaataaacccatccaaa

SEQ ID NO: 298517 - DNA, 264 bp, Homo sapiens
ccattatggcatgtgaagtcaccgccctgacacataaactctggaataattctgtgaaagcaggaacccttataaccaaatcctttctctccagtgcttagagcatgaaagttttctgccgtctttggaatcttgtttgcaaacagctcaaaggagatgcggcccaagggctccccgttgatggcgatgttgaagaacatggtggggttgaccacggctgatagtgtgttctagtgggttcttggtctcactgacttcaagaat

SEQ ID NO: 298518 - DNA, 439 bp, Homo sapiens
aagtcctaaccccacattacttttcaaggtgactgtatttggagacaggacctttaaagacatgattaagataaaatgaggtcatatgggtaggccttaattcagtctgactggtgttccataagaagaggatattaggacacagacacacagaggaaggaccgtgtgaagacgaagggggaagatgccgtccacaagccaaggagagaggccttagaggaaaccagccctgctgacaccttgatcttgggcttccagtctccagaacttgcttagagcatgaaagttttctgccgtctttggaatcttgtttgcaaacagctcaaaggagatgcggcccaagggctccccgttgatggcgatgttgaagaacatggtggggttgaccacggctgatagtgtgttctagtgggttcttggtctcactgacttcaagaat

SEQ ID NO: 298519 - DNA, 2999 bp, Homo sapiens
gaggtgaggccggactgaggctcttacagtggtccctgctggcccttggtgacgggtcgcgtcagttccgacccggacccgtacgctgctgcgctgacgtggctcccggaagtagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgagttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatctttggttgggacttattgcctgtccagtactgtgggtgatatttgcctttagtgcactcttctccttcagagtaaagtggttgagacggtctcgccacattgcccagactggtctgaaagtcttgggctcaagagatcctcccgcttccgccttccaaagcgctgggataacaggcgtgagccgctgcccgggccatccctcgaggaagtttcatcaggaatctgaacctgtgatgttaagaaatcagtaaatattaaaaagaagatggatgcaagaaggatgaagaaagaagaaggactcacagaaaacactggacttccccggaagctacttgaaaaacatgacccctggcggcctatgtcacctatacctctcagacagtgaaaagactcattgagaaaagcaaaactagagaactggaatgcatgcgtgccctcgaggaaagaccctgggcatcaaggcagaataaaccttccagcgtcattcagccgaaaaggaggaagtcttccaagtcttctggcaaagctgtgttcagggacacgctgtcagaatccacgttatcaatgtggggcgcttattcggtattggccatggctcctaccatgatcccagaacccacacacttacatgcggattccagagactgtccaactgaaaactataacaagatcatctttgcccgcaagcctatgatgaggatgctccctacagttcgctactgaccaacaaggagaaacatgcaaatgttttagccaggggtccctgcagccattccccaagaacgtacaaaagttaagctccatttaccactcacttgacagtgtcctttaaatctgaacttgctcttgctcatgcggagcttggctaagagaaaccagatcagaatgcaagctgtaggtgggtgggtgagtgtgtcccctcccacactgctctctggtgggtttgggcagtccctggctctagtctctgctgcagattctcaggaccaaaatgtgggtgatttgtctgggtccaggcaggagacagaaatcacacaagctcttttattagagataatataaagaatgattaaccaggtgacagtaaagggcaggaagggaatacaaaggtatccatggaggtagcaccacaggaagcaggcatcacacttgaggcttgggaacaaggggaagatgctggactcattgaaaggtggttgcttggagaagggacatggggctgaatctcagacttctgaggtgggggagtggggatgccactcaatgcagctggtatctctgagctctgaggagagtcctgtggggatggtgccccctcctctgaataggggagatgttttgttggtgtctctgaggggacccccatgaggctgcttttgtgagtgttggaaaaaccaaaaactgcattgaaatgtttctgggaggagttgccactgcctgggtgaagaaaaagcactgctagggttagcaacctgtctggcaagggacaggaagctgatagaaagtgaacaggaagcaaacaggaagtgagcaaggggccacttcctacttcctcctttagcctagcagattccttctagctccccctgggggctgagcctatcagggcacaaagccagaatgtggtttgtagaatcccagccccagcatctccaagcataggatggattttgaagccaagagggaattagctctcggccgggttctgagtgatcccatccagctgctcctggacctggtattgagaggtttttcccttggagggcaaacaaagtggcagtggggaccagggtgtcccctgctgagaaatggagagctcttttcccctgtacttctctggggtttgccttgtggaaccaagtgcttgggggaggagctcctggcaggactccagctgttatttgtcagaggacagctaggattggttcacccttgctctgagttggccccaaagcgagctatgctgaactcttctccatctccaagcagacaacctttgtctttacatgcaagagggatccaattatgacaggctgacccagctggtttcatgtttggggtttatctactgagtaaggctgaccttacctgagtttctgtatgtgtatttgcaagacagttaatactaatccatcatccctcacagagatgtagaggatgagatgtagtaacttatagcagtgtcatttggaaaagttgaatttgccctacaaggcatgttctccattcaagggtcttgtgtaaacgtttgcagacacaggtgcagctttggagaactcacctctggctcttgtgcttttatgttgggacagctgcctaaattaggagctctagacctgttattggttcccaactgttggccagaatgaattcttcgaaaaatataggtggtttccagggaatttgaatgattgtattttgtgtccatggaacgtttatagacatggaggcaggcaataaattcctccaataatttttttatctcttt

SEQ ID NO: 298520 - DNA, 2997 bp, Homo sapiens
gtcacgcccacagactcctgacctggtggcaccagatccagtctgaagggacgaggatggaggacggaggttcatatccacagggagagaggggccctgggaggagggggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgagttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatctttggttgggacttattgcctgtccagtactgtgggtgatatttgcctttagtgcactcttctccttcagagtaaagtggttggaacccagtgaaatgagctgcaccaggaactttaagagagagttttcagctgggagaagaggaaggcaagatatcagaacaagttaagcaaatctggccttgggttttgaccacagtctatccttccagtgggccaagagttgcttggaatgaatctgaacctgtgatgttaagaaatcagtaaatattaaaaagaagatggatgcaagaaggatgaagaaagaagaaggactcacagaaaacactggacttccccggaagctacttgaaaaacatgacccctggcggcctatgtcacctatacctctcagacagtgaaaagactcattgagaaaagcaaaactagagaactggaatgcatgcgtgccctcgaggaaagaccctgggcatcaaggcagaataaaccttccagcgtcattcagccgaaaaggaggaagtcttccaagtcttctggcaaagctgtgttcagggacacgctgtcagaatccacgttatcaatgtggggcgcttattcggtattggccatggctcctaccatgatcccagaacccacacacttacatgcggattccagagactgtccaactgaaaactataacaagatcatctttgcccgcaagcctatgatgaggatgctccctacagttcgctactgaccaacaaggagaaacatgcaaatgttttagccaggggtccctgcagccattccccaagaacgtacaaaagttaagctccatttaccactcacttgacagtgtcctttaaatctgaacttgctcttgctcatgcggagcttggctaagagaaaccagatcagaatgcaagctgtaggtgggtgggtgagtgtgtcccctcccacactgctctctggtgggtttgggcagtccctggctctagtctctgctgcagattctcaggaccaaaatgtgggtgatttgtctgggtccaggcaggagacagaaatcacacaagctcttttattagagataatataaagaatgattaaccaggtgacagtaaagggcaggaagggaatacaaaggtatccatggaggtagcaccacaggaagcaggcatcacacttgaggcttgggaacaaggggaagatgctggactcattgaaaggtggttgcttggagaagggacatggggctgaatctcagacttctgaggtgggggagtggggatgccactcaatgcagctggtatctctgagctctgaggagagtcctgtggggatggtgccccctcctctgaataggggagatgttttgttggtgtctctgaggggacccccatgaggctgcttttgtgagtgttggaaaaaccaaaaactgcattgaaatgtttctgggaggagttgccactgcctgggtgaagaaaaagcactgctagggttagcaacctgtctggcaagggacaggaagctgatagaaagtgaacaggaagcaaacaggaagtgagcaaggggccacttcctacttcctcctttagcctagcagattccttctagctccccctgggggctgagcctatcagggcacaaagccagaatgtggtttgtagaatcccagccccagcatctccaagcataggatggattttgaagccaagagggaattagctctcggccgggttctgagtgatcccatccagctgctcctggacctggtattgagaggtttttcccttggagggcaaacaaagtggcagtggggaccagggtgtcccctgctgagaaatggagagctcttttcccctgtacttctctggggtttgccttgtggaaccaagtgcttgggggaggagctcctggcaggactccagctgttatttgtcagaggacagctaggattggttcacccttgctctgagttggccccaaagcgagctatgctgaactcttctccatctccaagcagacaacctttgtctttacatgcaagagggatccaattatgacaggctgacccagctggtttcatgtttggggtttatctactgagtaaggctgaccttacctgagtttctgtatgtgtatttgcaagacagttaatactaatccatcatccctcacagagatgtagaggatgagatgtagtaacttatagcagtgtcatttggaaaagttgaatttgccctacaaggcatgttctccattcaagggtcttgtgtaaacgtttgcagacacaggtgcagctttggagaactcacctctggctcttgtgcttttatgttgggacagctgcctaaattaggagctctagacctgttattggttcccaactgttggccagaatgaattcttcgaaaaatataggtggtttccagggaatttgaatgattgtattttgtgtccatggaacgtttatagacatggaggcaggcaataaattcctccaataatttttttatctcttt

SEQ ID NO: 298521 - DNA, 2992 bp, Homo sapiens
cttgtcttagaaaggcaagttcttgggccccaccccacatatactgaatcagagaccctgggagtgggacccagcaatctgtcttaatagaccttctaggagattctggcactaaggaaagagaccacaggtcttgtctatctctgtagttggctgcgtctgggccagagtaactgcttgttgaaatgatcagagatctcaaatgaggtcatgcatgttggggtgtgtgtgtgtgcatgtgtgtgtgttgtgtatctttatgtgtgtatgtgtttggtctagggtccagcacatagtaggtgttcactcttgggggtgggaataatcactctaatgtccgtgtttgaggactgcattgctggtgaccgctgagcctgcagaggaggaagagagcagggcagaagattcaggagggggtgcatggcaacttctgatgtcacagtgccccccttcactcctgacttctggctcatgggtcactttggggcaggggcaagaggatggttagctgcagcaaagagagagccaaagagaagtgggattgagagcacaggggacagctggagacaaaatataaacgccgggcaggggaacagccaagatagtgcaggaaggatggggaatcacagaaacttctcaggaacccagtgaaatgagctgcaccaggaactttaagagagagttttcagctgggagaagaggaaggcaagatatcagaacaagaatctgaacctgtgatgttaagaaatcagtaaatattaaaaagaagatggatgcaagaaggatgaagaaagaagaaggactcacagaaaacactggacttccccggaagctacttgaaaaacatgacccctggcggcctatgtcacctatacctctcagacagtgaaaagactcattgagaaaagcaaaactagagaactggaatgcatgcgtgccctcgaggaaagaccctgggcatcaaggcagaataaaccttccagcgtcattcagccgaaaaggaggaagtcttccaagtcttctggcaaagctgtgttcagggacacgctgtcagaatccacgttatcaatgtggggcgcttattcggtattggccatggctcctaccatgatcccagaacccacacacttacatgcggattccagagactgtccaactgaaaactataacaagatcatctttgcccgcaagcctatgatgaggatgctccctacagttcgctactgaccaacaaggagaaacatgcaaatgttttagccaggggtccctgcagccattccccaagaacgtacaaaagttaagctccatttaccactcacttgacagtgtcctttaaatctgaacttgctcttgctcatgcggagcttggctaagagaaaccagatcagaatgcaagctgtaggtgggtgggtgagtgtgtcccctcccacactgctctctggtgggtttgggcagtccctggctctagtctctgctgcagattctcaggaccaaaatgtgggtgatttgtctgggtccaggcaggagacagaaatcacacaagctcttttattagagataatataaagaatgattaaccaggtgacagtaaagggcaggaagggaatacaaaggtatccatggaggtagcaccacaggaagcaggcatcacacttgaggcttgggaacaaggggaagatgctggactcattgaaaggtggttgcttggagaagggacatggggctgaatctcagacttctgaggtgggggagtggggatgccactcaatgcagctggtatctctgagctctgaggagagtcctgtggggatggtgccccctcctctgaataggggagatgttttgttggtgtctctgaggggacccccatgaggctgcttttgtgagtgttggaaaaaccaaaaactgcattgaaatgtttctgggaggagttgccactgcctgggtgaagaaaaagcactgctagggttagcaacctgtctggcaagggacaggaagctgatagaaagtgaacaggaagcaaacaggaagtgagcaaggggccacttcctacttcctcctttagcctagcagattccttctagctccccctgggggctgagcctatcagggcacaaagccagaatgtggtttgtagaatcccagccccagcatctccaagcataggatggattttgaagccaagagggaattagctctcggccgggttctgagtgatcccatccagctgctcctggacctggtattgagaggtttttcccttggagggcaaacaaagtggcagtggggaccagggtgtcccctgctgagaaatggagagctcttttcccctgtacttctctggggtttgccttgtggaaccaagtgcttgggggaggagctcctggcaggactccagctgttatttgtcagaggacagctaggattggttcacccttgctctgagttggccccaaagcgagctatgctgaactcttctccatctccaagcagacaacctttgtctttacatgcaagagggatccaattatgacaggctgacccagctggtttcatgtttggggtttatctactgagtaaggctgaccttacctgagtttctgtatgtgtatttgcaagacagttaatactaatccatcatccctcacagagatgtagaggatgagatgtagtaacttatagcagtgtcatttggaaaagttgaatttgccctacaaggcatgttctccattcaagggtcttgtgtaaacgtttgcagacacaggtgcagctttggagaactcacctctggctcttgtgcttttatgttgggacagctgcctaaattaggagctctagacctgttattggttcccaactgttggccagaatgaattcttcgaaaaatataggtggtttccagggaatttgaatgattgtattttgtgtccatggaacgtttatagacatggaggcaggcaataaattcctccaataatttttttatctcttt

SEQ ID NO: 298522 - DNA, 2879 bp, Homo sapiens
aaccatatacttataagtcaacttgcacagaatctcctgctagcttattttggtgaacacaaaactgaatgcaaaaatccccatccttcaaagaatttgacattctaatgtcaccaatttttcgacatgctaatgccagcaattttttttgaaagttgaaatagaacataataaggcaacaaaacgagactaagagggttctgcaccgtgttccaacaatcttcagtccccttcactgttcatgtctaagcactgaggcgttctaaagcaggtcaccttttgcctcaaggacttttcttgaaatatcatggtcttgctctgtcgcccaggctggagtgcagtggcgtggtcacagctcattgcagcttcgacttcctgggctgaagcgatcctcccatctcggcctgtcaagtagctggaaccacaggcgcgccactacacctggctaatttatttttattttattttttgtagagacggtctcgccacattgcccagactggtctgaaagtcttgggctcaagagatcctcccgcttccgccttccaaagcgctgggataacaggcgtgagccgctgcccgggccatccctcgaggaagtttcatcaggaatctgaacctgtgatgttaagaaatcagtaaatattaaaaagaagatggatgcaagaaggatgaagaaagaagaaggactcacagaaaacactggacttccccggaagctacttgaaaaacatgacccctggcggcctatgtcacctatacctctcagacagtgaaaagactcattgagaaaagcaaaactagagaactggaatgcatgcgtgccctcgaggaaagaccctgggcatcaaggcagaataaaccttccagcgtcattcagccgaaaaggaggaagtcttccaagtcttctggcaaagctgtgttcagggacacgctgtcagaatccacgttatcaatgtggggcgcttattcggtattggccatggctcctaccatgatcccagaacccacacacttacatgcggattccagagactgtccaactgaaaactataacaagatcatctttgcccgcaagcctatgatgaggatgctccctacagttcgctactgaccaacaaggagaaacatgcaaatgttttagccaggggtccctgcagccattccccaagaacgtacaaaagttaagctccatttaccactcacttgacagtgtcctttaaatctgaacttgctcttgctcatgcggagcttggctaagagaaaccagatcagaatgcaagctgtaggtgggtgggtgagtgtgtcccctcccacactgctctctggtgggtttgggcagtccctggctctagtctctgctgcagattctcaggaccaaaatgtgggtgatttgtctgggtccaggcaggagacagaaatcacacaagctcttttattagagataatataaagaatgattaaccaggtgacagtaaagggcaggaagggaatacaaaggtatccatggaggtagcaccacaggaagcaggcatcacacttgaggcttgggaacaaggggaagatgctggactcattgaaaggtggttgcttggagaagggacatggggctgaatctcagacttctgaggtgggggagtggggatgccactcaatgcagctggtatctctgagctctgaggagagtcctgtggggatggtgccccctcctctgaataggggagatgttttgttggtgtctctgaggggacccccatgaggctgcttttgtgagtgttggaaaaaccaaaaactgcattgaaatgtttctgggaggagttgccactgcctgggtgaagaaaaagcactgctagggttagcaacctgtctggcaagggacaggaagctgatagaaagtgaacaggaagcaaacaggaagtgagcaaggggccacttcctacttcctcctttagcctagcagattccttctagctccccctgggggctgagcctatcagggcacaaagccagaatgtggtttgtagaatcccagccccagcatctccaagcataggatggattttgaagccaagagggaattagctctcggccgggttctgagtgatcccatccagctgctcctggacctggtattgagaggtttttcccttggagggcaaacaaagtggcagtggggaccagggtgtcccctgctgagaaatggagagctcttttcccctgtacttctctggggtttgccttgtggaaccaagtgcttgggggaggagctcctggcaggactccagctgttatttgtcagaggacagctaggattggttcacccttgctctgagttggccccaaagcgagctatgctgaactcttctccatctccaagcagacaacctttgtctttacatgcaagagggatccaattatgacaggctgacccagctggtttcatgtttggggtttatctactgagtaaggctgaccttacctgagtttctgtatgtgtatttgcaagacagttaatactaatccatcatccctcacagagatgtagaggatgagatgtagtaacttatagcagtgtcatttggaaaagttgaatttgccctacaaggcatgttctccattcaagggtcttgtgtaaacgtttgcagacacaggtgcagctttggagaactcacctctggctcttgtgcttttatgttgggacagctgcctaaattaggagctctagacctgttattggttcccaactgttggccagaatgaattcttcgaaaaatataggtggtttccagggaatttgaatgattgtattttgtgtccatggaacgtttatagacatggaggcaggcaataaattcctccaataatttttttatctcttt

SEQ ID NO: 298523 - DNA, 2870 bp, Homo sapiens
gaggtgaggccggactgaggctcttacagtggtccctgctggcccttggtgacgggtcgcgtcagttccgacccggacccgtacgctgctgcgctgacgtggctcccggaagtagggctggcgtagggccgccatgttgcagcaggatagtaatgatgacactgaagatgtttcactgtttgatgcggaagaggagacgactaatagaccaagaaaagccaaaatcagaatgtcacaggtagactaatggttggcctacgttggtggaatcacattgatgaagatggaaagagccattgggtgtttgaatctagaaaggagtcctctcaagagaataaaactgtgtcagaggctgaatcaagaatctttggttgggacttattgcctgtccagtactgtgggtgatatttgcctttagtgcactcttctccttcagagtaaagtggttggaacccagtgaaatgagctgcaccaggaactttaagagagagttttcagctgggagaagaggaaggcaagatatcagaacaagttaagcaaatctggccttgggttttgaccacagtctatccttccagtgggccaagagttgcttggaatgaatctgaacctgtgatgttaagaaatcagtaaatattaaaaagaagatggatgcaagaaggatgaagaaagaagaaggactcacagaaaacactggacttccccggaagctacttgaaaaacatgacccctggcggcctatgtcacctatacctctcagacagtgaaaagactcattgagaaaagcaaaactagagaactggaatgcatgcgtgccctcgaggaaagaccctgggcatcaaggcagaataaaccttccagcgtcattcagccgaaaaggaggaagtcttccaagtcttctggcaaagctgtgttcagggacacgctgtcagaatccacgttatcaatgtggggcgcttattcggtattggccatggctcctaccatgatcccagaacccacacacttacatgcggattccagagactgtccaactgaaaactataacaagatcatctttgcccgcaagcctatgatgaggatgctccctacagttcgctactgaccaacaaggagaaacatgcaaatgttttagccaggggtccctgcagccattccccaagaacgtacaaaagttaagctccatttaccactcacttgacagtgtcctttaaatctgaacttgctcttgctcatgcggagcttggctaagagaaaccagatcagaatgcaagctgtaggtgggtgggtgagtgtgtcccctcccacactgctctctggtgggtttgggcagtccctggctctagtctctgctgcagattctcaggaccaaaatgtgggtgatttgtctgggtccaggcaggagacagaaatcacacaagctcttttattagagataatataaagaatgattaaccaggtgacagtaaagggcaggaagggaatacaaaggtatccatggaggtagcaccacaggaagcaggcatcacacttgaggcttgggaacaaggggaagatgctggactcattgaaaggtggttgcttggagaagggacatggggctgaatctcagacttctgaggtgggggagtggggatgccactcaatgcagctggtatctctgagctctgaggagagtcctgtggggatggtgccccctcctctgaataggggagatgttttgttggtgtctctgaggggacccccatgaggctgcttttgtgagtgttggaaaaaccaaaaactgcattgaaatgtttctgggaggagttgccactgcctgggtgaagaaaaagcactgctagggttagcaacctgtctggcaagggacaggaagctgatagaaagtgaacaggaagcaaacaggaagtgagcaaggggccacttcctacttcctcctttagcctagcagattccttctagctccccctgggggctgagcctatcagggcacaaagccagaatgtggtttgtagaatcccagccccagcatctccaagcataggatggattttgaagccaagagggaattagctctcggccgggttctgagtgatcccatccagctgctcctggacctggtattgagaggtttttcccttggagggcaaacaaagtggcagtggggaccagggtgtcccctgctgagaaatggagagctcttttcccctgtacttctctggggtttgccttgtggaaccaagtgcttgggggaggagctcctggcaggactccagctgttatttgtcagaggacagctaggattggttcacccttgctctgagttggccccaaagcgagctatgctgaactcttctccatctccaagcagacaacctttgtctttacatgcaagagggatccaattatgacaggctgacccagctggtttcatgtttggggtttatctactgagtaaggctgaccttacctgagtttctgtatgtgtatttgcaagacagttaatactaatccatcatccctcacagagatgtagaggatgagatgtagtaacttatagcagtgtcatttggaaaagttgaatttgccctacaaggcatgttctccattcaagggtcttgtgtaaacgtttgcagacacaggtgcagctttggagaactcacctctggctcttgtgcttttatgttgggacagctgcctaaattaggagctctagacctgttattggttcccaactgttggccagaatgaattcttcgaaaaatataggtggtttccagggaatttgaatgattgtattttgtgtccatggaacgtttatagacatggaggcaggcaataaattcctccaataatttttttatctcttt

SEQ ID NO: 298524 - DNA, 2262 bp, Homo sapiens
gtgcaccgtgattcgtatagccgttctagagtatcccccggcatgcagctagggatcaagaatgaagaaggactcacagaaaacactggacttccccggaagctacttgaaaaacatgacccctggcggcctatgtcacctatacctctcagacagtgaaaagactcattgagaaaagcaaaactagagaactggaatgcatgcgtgccctcgaggaaagaccctgggcatcaaggcagaataaaccttccagcgtcattcagccgaaaaggaggaagtcttccaagtcttctggcaaagctgtgttcagggacacgctgtcagaatccacgttatcaatgtggggcgcttattcggtattggccatggctcctaccatgatcccagaacccacacacttacatgcggattccagagactgtccaactgaaaactataacaagatcatctttgcccgcaagcctatgatgaggatgctccctacagttcgctactgaccaacaaggagaaacatgcaaatgttttagccaggggtccctgcagccattccccaagaacgtacaaaagttaagctccatttaccactcacttgacagtgtcctttaaatctgaacttgctcttgctcatgcggagcttggctaagagaaaccagatcagaatgcaagctgtaggtgggtgggtgagtgtgtcccctcccacactgctctctggtgggtttgggcagtccctggctctagtctctgctgcagattctcaggaccaaaatgtgggtgatttgtctgggtccaggcaggagacagaaatcacacaagctcttttattagagataatataaagaatgattaaccaggtgacagtaaagggcaggaagggaatacaaaggtatccatggaggtagcaccacaggaagcaggcatcacacttgaggcttgggaacaaggggaagatgctggactcattgaaaggtggttgcttggagaagggacatggggctgaatctcagacttctgaggtgggggagtggggatgccactcaatgcagctggtatctctgagctctgaggagagtcctgtggggatggtgccccctcctctgaataggggagatgttttgttggtgtctctgaggggacccccatgaggctgcttttgtgagtgttggaaaaaccaaaaactgcattgaaatgtttctgggaggagttgccactgcctgggtgaagaaaaagcactgctagggttagcaacctgtctggcaagggacaggaagctgatagaaagtgaacaggaagcaaacaggaagtgagcaaggggccacttcctacttcctcctttagcctagcagattccttctagctccccctgggggctgagcctatcagggcacaaagccagaatgtggtttgtagaatcccagccccagcatctccaagcataggatggattttgaagccaagagggaattagctctcggccgggttctgagtgatcccatccagctgctcctggacctggtattgagaggtttttcccttggagggcaaacaaagtggcagtggggaccagggtgtcccctgctgagaaatggagagctcttttcccctgtacttctctggggtttgccttgtggaaccaagtgcttgggggaggagctcctggcaggactccagctgttatttgtcagaggacagctaggattggttcacccttgctctgagttggccccaaagcgagctatgctgaactcttctccatctccaagcagacaacctttgtctttacatgcaagagggatccaattatgacaggctgacccagctggtttcatgtttggggtttatctactgagtaaggctgaccttacctgagtttctgtatgtgtatttgcaagacagttaatactaatccatcatccctcacagagatgtagaggatgagatgtagtaacttatagcagtgtcatttggaaaagttgaatttgccctacaaggcatgttctccattcaagggtcttgtgtaaacgtttgcagacacaggtgcagctttggagaactcacctctggctcttgtgcttttatgttgggacagctgcctaaattaggagctctagacctgttattggttcccaactgttggccagaatgaattcttcgaaaaatataggtggtttccagggaatttgaatgattgtattttgtgtccatggaacgtttatagacatggaggcaggcaataaattcctccaataatttttttatctcttt

SEQ ID NO: 298525 - DNA, 1851 bp, Homo sapiens
tatagccccatggctgccttcattaccactacctcttcagtgttgagaacacacatgcgttgaatgtgtaatcagtatataactgtgggtctgtgtggcctgggctgtgcatgatgctgactcaaataaacaccattccccaagaacgtacaaaagttaagctccatttaccactcacttgacagtgtcctttaaatctgaacttgctcttgctcatgcggagcttggctaagagaaaccagatcagaatgcaagctgtaggtgggtgggtgagtgtgtcccctcccacactgctctctggtgggtttgggcagtccctggctctagtctctgctgcagattctcaggaccaaaatgtgggtgatttgtctgggtccaggcaggagacagaaatcacacaagctcttttattagagataatataaagaatgattaaccaggtgacagtaaagggcaggaagggaatacaaaggtatccatggaggtagcaccacaggaagcaggcatcacacttgaggcttgggaacaaggggaagatgctggactcattgaaaggtggttgcttggagaagggacatggggctgaatctcagacttctgaggtgggggagtggggatgccactcaatgcagctggtatctctgagctctgaggagagtcctgtggggatggtgccccctcctctgaataggggagatgttttgttggtgtctctgaggggacccccatgaggctgcttttgtgagtgttggaaaaaccaaaaactgcattgaaatgtttctgggaggagttgccactgcctgggtgaagaaaaagcactgctagggttagcaacctgtctggcaagggacaggaagctgatagaaagtgaacaggaagcaaacaggaagtgagcaaggggccacttcctacttcctcctttagcctagcagattccttctagctccccctgggggctgagcctatcagggcacaaagccagaatgtggtttgtagaatcccagccccagcatctccaagcataggatggattttgaagccaagagggaattagctctcggccgggttctgagtgatcccatccagctgctcctggacctggtattgagaggtttttcccttggagggcaaacaaagtggcagtggggaccagggtgtcccctgctgagaaatggagagctcttttcccctgtacttctctggggtttgccttgtggaaccaagtgcttgggggaggagctcctggcaggactccagctgttatttgtcagaggacagctaggattggttcacccttgctctgagttggccccaaagcgagctatgctgaactcttctccatctccaagcagacaacctttgtctttacatgcaagagggatccaattatgacaggctgacccagctggtttcatgtttggggtttatctactgagtaaggctgaccttacctgagtttctgtatgtgtatttgcaagacagttaatactaatccatcatccctcacagagatgtagaggatgagatgtagtaacttatagcagtgtcatttggaaaagttgaatttgccctacaaggcatgttctccattcaagggtcttgtgtaaacgtttgcagacacaggtgcagctttggagaactcacctctggctcttgtgcttttatgttgggacagctgcctaaattaggagctctagacctgttattggttcccaactgttggccagaatgaattcttcgaaaaatataggtggtttccagggaatttgaatgattgtattttgtgtccatggaacgtttatagacatggaggcaggcaataaattcctccaataatttttttatctcttt

SEQ ID NO: 298526 - DNA, 987 bp, Homo sapiens
gtcacgcccacagactcctgacctggtggcaccagatccagtctgaagggacgaggatggaggacggaggttcatatccacagggagagaggggccctgggaggagggggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgagttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaaggagtcctctcaagagaataaaactgtgtcagaggctgaatcaagaatctttggttgggacttattgcctgtccagtactgtgggtgatatttgcctttagtgcactcttctccttcagagtaaagtggttggtgactgtatttggagacaggacctttaaagacatgattaagataaaatgaggtcatatgggtaggccttaattcagtctgactggtgttccataagaagaggatattaggacacagacacacagaggaaggaccgtgtgaagacgaagggggaagatgccgtccacaagccaaggagagaggccttagaggaaaccagccctgctgacaccttgatcttgggcttccagtctccagaacttgcttagagcatgaaagttttctgccgtctttggaatcttgtttgcaaacagctcaaaggagatgcggcccaagggctccccgttgatggcgatgttgaagaacatggtggggttgaccacggctgatagtgtgttctagtgggttcttggtctcactgacttcaagaat

SEQ ID NO: 298527 - DNA, 962 bp, Homo sapiens
  misc_feature (817)..(817): n is a, c, g, or t
gaggtgaggccggactgaggctcttacagtggtccctgctggcccttggtgacgggtcgcgtcagttccgacccggacccgtacgctgctgcgctgacgtggctcccggaagtagggctggcgtagggccgccatgttgcagcaggatagtaatgatgacactgaagatgtttcactgtttgatgcggaagaggagacgactaatagaccaagaaaagccaaaatcagacatccagtagcatcgtttttccacttattctttcgagtcagtgcaatcatcgtctatcttctctgtgagttgctcagcagcagctttattacctgtatggtgacaattatcttgttgttgtcgtgtgacttttgggcagtgaagaatgtcacaggtagactaatggttggcctacgttggtggaatcacattgatgaagatggaaagagccattgggtgtttgaatctagaaagttattgcctgtccagtactgtgggtgatatttgcctttagtgcactcttctccttcagagtaaagtggttggcggtggttatcatgggtgtggtgctacaaggtgccaacctgtatggttacatcaggtgtaaggtgcgcagcagaaagcatttaaccagcatggctacttcatattttggaaagcagtttttaagacaaacactggagatgatcagacttcctgaatagagaaagcttatgtgcttgttacattggggaacactgaagagattcttgatcaaccttttagagcttagcccatgtgcacgaggagggtggcttgtttttccacttaaaactttttttacacggnaggttcaataagttattccttcccacggctcaattggggcaaccctccacttcggggtgcaccccgttaccgtgacatcacatgaggctataggacctcgcacagcgtttccactatatcggtgagcgccgacttgcgcaatttc

SEQ ID NO: 298528 - DNA, 434 bp, Homo sapiens
tgtgaaggagccagaaaccttgagattatccccagtagcctcggcttgctctgtgacttgggagagaacaggtgaggaggacaggtgttaagttgtagtagcctcatctgcaccccagagttttctcagatggtgcagcctaggggcagggatggaggagctgagacttcgattattctctggggtttttgccagatgatttgaggaggcgggtggaggatctgcatgtgtccttttctaggttttgaattcctgatgctgtaaccacattattttatcttctattttgatgagtatgcagctttgcattgcagtggctgtgtaaacactgaattttgttttgcttcttgaccatttatttttccaaccaggatagtaatgatgacactgaagatgtttcactgtttgatgcggaagaggagacgactaataga

SEQ ID NO: 298529 - DNA, 369 bp, Homo sapiens
gaactttaagagagagttttcagctgggagaagaggaaggcaagatatcagaacaagttaagcaaatctggccttgggttttgaccacagtctatccttccagtgggccaagagttgcttggaatgtaaggatttcacttctgagccttaaaaacacaatttaaggagagagagggagagagagaaagagaaagagaaagagagagagacacatcccaactaaataacacataatgggatagacggccttgatagataaggttcagataagatacttgggagcagagaggagggcctgtctatttcacctagaggcctgggccagcctctcaaaagaagtatcactggagccgtcctggaagggaagga

SEQ ID NO: 298530 - DNA, 1243 bp, Homo sapiens
acaggtttgcgccaccacacccagctaatttttgtattttttttttagtagagaccgggtctcaccatgttggccaggctggtctcacctgactttgtgatccgcccgcctcagcctcccaaagtgctgggattacaggtgtgagccaccacgcctggcctcaagcctggtctgaatatctatatgcaaatatgggacactgacttcagagctattcatttagctccagtcatagcaattctgtagtttcctcacatttactgtgtctttgtccacaaatgaaatatgttgtaaggtcagtgttaatttcgtgagacgatatagatgaacacacttgctcattttttgaaataaatatgcagatttaaaatgagtggcacatatatataaataggttattgaatgggtattctcttttccctttaatttaaaaagtgatatttatttattaaaaggagcattggtagaattattggtttatagtatcttctttaataatccttacaattacatatactaataggatgttaaaattatcatcgtgtttcctatttgtgtttagattcttataaagcatgagatgagtaatcaagggaagggtcgcatctccatgtttgccccatgaatagaatccatttgacaagccatttcatttcctttctggagaaagggagttgtttttttttttctttttacagcaaaaatttaaggttttattgggggagggggtggtgctacttcctctgtaacatgtttttaaaactatgattatggtttttggttgttttttgttttgtttgtttccttttagtctgtttttaatatccttccccttaactcttaaggaaagtcttctttcctacagggctgtgaattaaggaatgggtagcgtttacatttaagtacaccaatgtctgcccaatttcctaatgtatacatttgttttattttaaattattttttgttcttaaaaatactagaagaaaacatagatgtttctagtgcctttgaacttatactgtagtctgactaatttaatgaataacttcagtagcattactataatactgtatgctggccaaaattacaaattacagtttgttgcatcagtttcaaaagccatgctttcattgtattttatgtataaattgtatttgttcaagttgtatatattggtattgtatgtatacatgcagcatggttaaataagaataaaaatcttttacctaatgcctgtagtagt

SEQ ID NO: 298531 - DNA, 1201 bp, Homo sapiens
ggtagagacaaagtctcgctagtgttgccctggctggtctcaaactcgagaccaaagtctctggccaccttgcctcccaaagtgctgggattacaggtgtgagccaccacgcctggcctcaagcctggtctgaatatctatatgcaaatatgggacactgacttcagagctattcatttagctccagtcatagcaattctgtagtttcctcacatttactgtgtctttgtccacaaatgaaatatgttgtaaggtcagtgttaatttcgtgagacgatatagatgaacacacttgctcattttttgaaataaatatgcagatttaaaatgagtggcacatatatataaataggttattgaatgggtattctcttttccctttaatttaaaaagtgatatttatttattaaaaggagcattggtagaattattggtttatagtatcttctttaataatccttacaattacatatactaataggatgttaaaattatcatcgtgtttcctatttgtgtttagattcttataaagcatgagatgagtaatcaagggaagggtcgcatctccatgtttgccccatgaatagaatccatttgacaagccatttcatttcctttctggagaaagggagttgtttttttttttctttttacagcaaaaatttaaggttttattgggggagggggtggtgctacttcctctgtaacatgtttttaaaactatgattatggtttttggttgttttttgttttgtttgtttccttttagtctgtttttaatatccttccccttaactcttaaggaaagtcttctttcctacagggctgtgaattaaggaatgggtagcgtttacatttaagtacaccaatgtctgcccaatttcctaatgtatacatttgttttattttaaattattttttgttcttaaaaatactagaagaaaacatagatgtttctagtgcctttgaacttatactgtagtctgactaatttaatgaataacttcagtagcattactataatactgtatgctggccaaaattacaaattacagtttgttgcatcagtttcaaaagccatgctttcattgtattttatgtataaattgtatttgttcaagttgtatatattggtattgtatgtatacatgcagcatggttaaataagaataaaaatcttttacctaatgcctgtagtagt

SEQ ID NO: 298532 - DNA, 1189 bp, Homo sapiens
acaggtttgcgccaccacacccagctaatttttgtattttttttttagtagagaccgggtctcaccatgttggccaggctggtctcacctgactttgtgatccgcccgcctcagcctcccaaagtgctgggattacaggtgtgagccaccacgcctggcctcaagcctggtctgaatatctatatgcaaatatgggacactgacttcagagctattcatttagctccagtcatagcaattctgtagtttcctcacatttactgtgtctttgtccacaaatgaaatatgttgtaaggtcagtgttaatttcgtgagacgatatagatgaacacacttgctcattttttgaaataaatatgcagatttaaaatgagtggcacatatatataaataggttattgaatgggtattctcttttccctttaatttaaaaagtgatatttatttattaaaaggagcattggtagaattattggtttatagtatcttctttaataatccttacaattacatatactaataggatgttaaaattatcatcgtgtttcctatttgtgtttagattcttataaagcatgagatgagtaatcaagggaagggtcgcatctccatgtttgccccatgaatagaatccatttgacaagccatttcatttcctttctggagaaagggagttgtttttttttttctttttacagcaaaaatttaaggttttattgggggagggggtggtgctacttcctctgtaacatgtttttaaaactatgattatggtttttggttgttttttgttttgtttgtttccttttagtctgtttttaatatccttccccttaactcttaaggaaagtcttctttcctacagggctgtgaattaaggaatgggtagcgtttacatttaagtacaccaatgtctgcccaatttcctaatgtatacatttgttttattttaaattattttttgttcttaaaaatactagaagatgaataacttcagtagcattactataatactgtatgctggccaaaattacaaattacagtttgttgcatcagtttcaaaagccatgctttcattgtattttatgtataaattgtatttgttcaagttgtatatattggtattgtatgtatacatgcagcatggttaaataagaataaaaatcttttacctaatgcctgtagtagt

SEQ ID NO: 298533 - DNA, 1441 bp, Homo sapiens
caacaagactgcaacatcccctcacgcctagtctgtaaagaactttgtttaacccggaggcggggccagccagctccgcccctccagctggacgcgggagcgaggttgaggttcatacccctgggttctctccaggcctgaggcggagagccagccgcctgcctacctctgggctttgaaccccgggtctggtgacttcgcttaaagacctcgggccgaaggcccgccaggctcaacctcggttcacaggacccccgacttgtgtgagtcgtacaccgctctttaccgtctctggacctaggtcatctcggcagtaaaatggggtgaaatgacccgacctccccggaggatgccgcgcacgatgtgtgcctcaagttggcttccactgacctgaactgttaagaaagccctcctcagtgacgccttccctgaatccacagtggagattgccgttttcctggaactaattcacccacacttacccatttcatccctttccaccttttatttctacctttctgccccactgatctctagaataggtgctgggagacgttagagtatttgatctcccactccccagtcatcccacttaccgagcagtaattctctgcctggctgcacattgcaatcacttgggaagcctctaaaaatactgatgccagggctctaccccaagccagttaaaatctccagcgctggacctgggcattggtactttttgtaaagctttcaggtcaaggaagagcaagactgaaaatgtttaccagatttataatcgaggaggtcctggatgaccttggcaaaagcaaccccaatggcatgggaatgaatgtttaccaagatgatgccagtatagctagtgagatgcagcaccccatcctcagccccctcgcctctggaagagacaccagactgcaaagggcaccgcgtacagaagctaacggaacttgaatgacaagacaaaaagagcagaatcagttagtgtgacacaacattctaacatgcctgattcttacatcaaatatggtaactttggggttggtagggggagacaaacaaggagaatccacttgggaacaatttgatgaagtttgcaaatcagcactttacccccaaattaacaacagcttgtatggaaaaaaaaatgctcttttaaaagtatatggtttggacaggtaaatttgttttctcttgtagtttttgtaaaaaagtatcaaaaccttggctttaaatatatatatatatatatatacacacacacacacgtggctttttaaaaattacttttttatagcacaaagtgtttgtaaatgcagagggtttctgctaattcttgactgtgcacatggtgcatagcctgaatgaacagagcttcctgatttttttttaactgaaaaattgaagcagtaattctttaaccttctaaattctccatacc

SEQ ID NO: 298534 - DNA, 683 bp, Homo sapiens
agtttttttttaaatgaatttaatctctctctagaaacagtgcactgattttacaaatgtccacatttggttttcagtttaccaagatgatgccagtatagctagtgagatgcagcaccccatcctcagccccctcgcctctggaagagacaccagactgcaaagggcaccgcgtacagaagctaacggaacttgaatgacaagacaaaaagagcagaatcagttagtgtgacacaacattctaacatgcctgattcttacatcaaatatggtaactttggggttggtagggggagacaaacaaggagaatccacttgggaacaatttgatgaagtttgcaaatcagcactttacccccaaattaacaacagcttgtatggaaaaaaaaatgctcttttaaaagtatatggtttggacaggtaaatttgttttctcttgtagtttttgtaaaaaagtatcaaaaccttggctttaaatatatatatatatatatatacacacacacacacgtggctttttaaaaattacttttttatagcacaaagtgtttgtaaatgcagagggtttctgctaattcttgactgtgcacatggtgcatagcctgaatgaacagagcttcctgatttttttttaactgaaaaattgaagcagtaattctttaaccttctaaattctccatacc

SEQ ID NO: 298535 - DNA, 7789 bp, Homo sapiens
  misc_feature (3812)..(3812): n is a, c, g, or t
  misc_feature (4603)..(4603): n is a, c, g, or t
cgggggagcgcggcgcggccgccgcgtgcgcgagccggggttgcagcccagccgggactttccagccggcggcagccgcggcggccgccggctcttccccgccccccgccatggggcagcccggggagcagaacgctgcggaccgcggcggaggacgcgcccggcgcccctgagccggccgagcggcgacggaccgcgagatgaggaaaatgaggcccaaagaagtgatgccacttggttaaggtcccagagcaggtcagaatcagacctaggatcagaaacctggctcctggctcctggctccctactcttctaaggatcgctgtcctgacagaagagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaacgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgagttgagtgcacacttgtcagagtgtgtcaatgcccccagcacctgtagttttaagcgctatggctgcgtttttcaggggacaaaccagcagatcaaggcccacgaggccagctccgccgtgcagcacgtcaacctgctgaaggagtggagcaactcgctcgaaaagaaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggacgagctctctgttgctgacagcaccggccttcggtctccatgtcaggggtgggcgggtgactgctgagggaggcccgcaggtgtgtttctccatcccgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtntgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcacacactttgtccttgaacctgagtgatgggggtcnttgaggatgggatggcctgtgtcacgcgctttgtctttgtgtttggttgtatcggggtctctgttctgagtgtgtcttcctctcatgtactcaacacagtgggcagcagcctgggacggcgtcccctctcccggcggcgggcaagccttgcgctgctccaccctcggcctgggcaccctcacttggcgctggccacctgggccagcctggggccatggtctctctgcagctgaggcccagtggccccttgggcagtgatcggccctccccgcatcacagggccctggcagcaagcgggaaatgggggcgcacactgtgtgcttgggggtgctgcttgtttaccacacatgaccagactcccagcaggacagagctgctcagtactttacagaaaccaactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaaagtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctcggtgaggatgcagttctaggcacagcccctgggacagccagctgcctcccagaccacgtcagcctgctccagggtcctcagtcaccctgggccaggggccacgtgtcccatggatgtcgaccatgccaacgtcacattccagcaccccttttgcttgatggcgtctggtggtagtcagcatggtggacccacatcctacagccagaggtgatgttggacaaaggaaggggagtctggatgggtccttaaacgaccattctgtccgcagcggggtcattccttgtcagcccaagggagggccggggagtacactgatcccaacagctgggctgacacctcctttctcccctgcacggggaggattggcctgaggaccgtcaccctgtgcacagccccagtagggtggcagtgccactgtctccttgggccgttgcaggattgggcgggtgcagactccccttgcgggccccttgctcaatccccggccctcccagactcctccctctactgggggtaatttgtgtgtcagaagggctctggcagagctgtaaaatactgttttttaaaaattttagtccagatctttacttattagactgcagaaggagagctagggagagtgggggaagcccccttgcttttgtatctgtgaggtgaatgagggtctgtcacccaaatctacttctcagcccatgaccatagttctgttttccgtttgcaaatctcagtagctctgttttctccaaagtagaatgtgcgcaccggggtcctagccaggcgaggtcagtgtcggcaggctacctggtcattattgctgcctcgtccaggctgatgctgatggtcacaggcacggtggcatcagggagccgggccagcaggcggcgtgaggcggggccagcagctcactgcaagggcattttccacctgatcctggtgtgccccacatgcggtggcagggcagacgtgtgaagcctcggccgtctcggggctggcaggtgtgcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcagtgtcgacgctgcacagcatctgcagattcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctcaaaaatgatca

SEQ ID NO: 298536 - DNA, 7650 bp, Homo sapiens
  misc_feature (3673)..(3673): n is a, c, g, or t
  misc_feature (4464)..(4464): n is a, c, g, or t
cgggggagcgcggcgcggccgccgcgtgcgcgagccggggttgcagcccagccgggactttccagccggcggcagccgcggcggccgccggctcttccccgccccccgccatggggcagcccggggagcagaacgctgcggaccgcggcggaggacgcgcccggcgcccctgagccggccgagcggcgacggaccgcgagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaacgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgagttgagtgcacacttgtcagagtgtgtcaatgcccccagcacctgtagttttaagcgctatggctgcgtttttcaggggacaaaccagcagatcaaggcccacgaggccagctccgccgtgcagcacgtcaacctgctgaaggagtggagcaactcgctcgaaaagaaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggacgagctctctgttgctgacagcaccggccttcggtctccatgtcaggggtgggcgggtgactgctgagggaggcccgcaggtgtgtttctccatcccgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtntgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcacacactttgtccttgaacctgagtgatgggggtcnttgaggatgggatggcctgtgtcacgcgctttgtctttgtgtttggttgtatcggggtctctgttctgagtgtgtcttcctctcatgtactcaacacagtgggcagcagcctgggacggcgtcccctctcccggcggcgggcaagccttgcgctgctccaccctcggcctgggcaccctcacttggcgctggccacctgggccagcctggggccatggtctctctgcagctgaggcccagtggccccttgggcagtgatcggccctccccgcatcacagggccctggcagcaagcgggaaatgggggcgcacactgtgtgcttgggggtgctgcttgtttaccacacatgaccagactcccagcaggacagagctgctcagtactttacagaaaccaactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaaagtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctcggtgaggatgcagttctaggcacagcccctgggacagccagctgcctcccagaccacgtcagcctgctccagggtcctcagtcaccctgggccaggggccacgtgtcccatggatgtcgaccatgccaacgtcacattccagcaccccttttgcttgatggcgtctggtggtagtcagcatggtggacccacatcctacagccagaggtgatgttggacaaaggaaggggagtctggatgggtccttaaacgaccattctgtccgcagcggggtcattccttgtcagcccaagggagggccggggagtacactgatcccaacagctgggctgacacctcctttctcccctgcacggggaggattggcctgaggaccgtcaccctgtgcacagccccagtagggtggcagtgccactgtctccttgggccgttgcaggattgggcgggtgcagactccccttgcgggccccttgctcaatccccggccctcccagactcctccctctactgggggtaatttgtgtgtcagaagggctctggcagagctgtaaaatactgttttttaaaaattttagtccagatctttacttattagactgcagaaggagagctagggagagtgggggaagcccccttgcttttgtatctgtgaggtgaatgagggtctgtcacccaaatctacttctcagcccatgaccatagttctgttttccgtttgcaaatctcagtagctctgttttctccaaagtagaatgtgcgcaccggggtcctagccaggcgaggtcagtgtcggcaggctacctggtcattattgctgcctcgtccaggctgatgctgatggtcacaggcacggtggcatcagggagccgggccagcaggcggcgtgaggcggggccagcagctcactgcaagggcattttccacctgatcctggtgtgccccacatgcggtggcagggcagacgtgtgaagcctcggccgtctcggggctggcaggtgtgcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcagtgtcgacgctgcacagcatctgcagattcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctcaaaaatgatca

SEQ ID NO: 298537 - DNA, 7714 bp, Homo sapiens
  misc_feature (3737)..(3737): n is a, c, g, or t
  misc_feature (4528)..(4528): n is a, c, g, or t
cgggggagcgcggcgcggccgccgcgtgcgcgagccggggttgcagcccagccgggactttccagccggcggcagccgcggcggccgccggctcttccccgccccccgccatggggcagcccggggagcagaacgctgcggaccgcggcggaggacgcgcccggcgcccctgagccggccgagcggcgacggaccgcgagatgaggaaaatgaggcccaaagaagtgatgccacttggttaaggtcccagagcaggtcagaatcagacctaggatcagaaacctggctcctggctcctggctccctactcttctaaggatcgctgtcctgacagaagagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaacgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgaggggacaaaccagcagatcaaggcccacgaggccagctccgccgtgcagcacgtcaacctgctgaaggagtggagcaactcgctcgaaaagaaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggacgagctctctgttgctgacagcaccggccttcggtctccatgtcaggggtgggcgggtgactgctgagggaggcccgcaggtgtgtttctccatcccgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtntgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcacacactttgtccttgaacctgagtgatgggggtcnttgaggatgggatggcctgtgtcacgcgctttgtctttgtgtttggttgtatcggggtctctgttctgagtgtgtcttcctctcatgtactcaacacagtgggcagcagcctgggacggcgtcccctctcccggcggcgggcaagccttgcgctgctccaccctcggcctgggcaccctcacttggcgctggccacctgggccagcctggggccatggtctctctgcagctgaggcccagtggccccttgggcagtgatcggccctccccgcatcacagggccctggcagcaagcgggaaatgggggcgcacactgtgtgcttgggggtgctgcttgtttaccacacatgaccagactcccagcaggacagagctgctcagtactttacagaaaccaactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaaagtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctcggtgaggatgcagttctaggcacagcccctgggacagccagctgcctcccagaccacgtcagcctgctccagggtcctcagtcaccctgggccaggggccacgtgtcccatggatgtcgaccatgccaacgtcacattccagcaccccttttgcttgatggcgtctggtggtagtcagcatggtggacccacatcctacagccagaggtgatgttggacaaaggaaggggagtctggatgggtccttaaacgaccattctgtccgcagcggggtcattccttgtcagcccaagggagggccggggagtacactgatcccaacagctgggctgacacctcctttctcccctgcacggggaggattggcctgaggaccgtcaccctgtgcacagccccagtagggtggcagtgccactgtctccttgggccgttgcaggattgggcgggtgcagactccccttgcgggccccttgctcaatccccggccctcccagactcctccctctactgggggtaatttgtgtgtcagaagggctctggcagagctgtaaaatactgttttttaaaaattttagtccagatctttacttattagactgcagaaggagagctagggagagtgggggaagcccccttgcttttgtatctgtgaggtgaatgagggtctgtcacccaaatctacttctcagcccatgaccatagttctgttttccgtttgcaaatctcagtagctctgttttctccaaagtagaatgtgcgcaccggggtcctagccaggcgaggtcagtgtcggcaggctacctggtcattattgctgcctcgtccaggctgatgctgatggtcacaggcacggtggcatcagggagccgggccagcaggcggcgtgaggcggggccagcagctcactgcaagggcattttccacctgatcctggtgtgccccacatgcggtggcagggcagacgtgtgaagcctcggccgtctcggggctggcaggtgtgcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcagtgtcgacgctgcacagcatctgcagattcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctcaaaaatgatca

SEQ ID NO: 298538 - DNA, 7916 bp, Homo sapiens
  misc_feature (3939)..(3939): n is a, c, g, or t
  misc_feature (4730)..(4730): n is a, c, g, or t
cgggggagcgcggcgcggccgccgcgtgcgcgagccggggttgcagcccagccgggactttccagccggcggcagccgcggcggccgccggctcttccccgccccccgccatggggcagcccggggagcagaacgctgcggaccgcggcggaggacgcgcccggcgcccctgagccggccgagcggcgacggaccgcgagatgaggaaaatgaggcccaaagaagtgatgccacttggttaaggtcccagagcaggtcagaatcagacctaggatcagaaacctggctcctggctcctggctccctactcttctaaggatcgctgtcctgacagaagagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaacgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcagaaacacgaagacaccgactgtccctgcgtggtggtgtcctgccctcacaagtgcagcgtccagactctcctgaggagcgagttgagtgcacacttgtcagagtgtgtcaatgcccccagcacctgtagttttaagcgctatggctgcgtttttcaggggacaaaccagcagatcaaggcccacgaggccagctccgccgtgcagcacgtcaacctgctgaaggagtggagcaactcgctcgaaaagaagggatatgagaataaagagtctgagaattctgtcccgtctttgacagatggaaatgaatgaattgttactttcagagggacacaactaccacgcgatgctgcatatggcccgctccacattcgtgcaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggacgagctctctgttgctgacagcaccggccttcggtctccatgtcaggggtgggcgggtgactgctgagggaggcccgcaggtgtgtttctccatcccgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtntgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcacacactttgtccttgaacctgagtgatgggggtcnttgaggatgggatggcctgtgtcacgcgctttgtctttgtgtttggttgtatcggggtctctgttctgagtgtgtcttcctctcatgtactcaacacagtgggcagcagcctgggacggcgtcccctctcccggcggcgggcaagccttgcgctgctccaccctcggcctgggcaccctcacttggcgctggccacctgggccagcctggggccatggtctctctgcagctgaggcccagtggccccttgggcagtgatcggccctccccgcatcacagggccctggcagcaagcgggaaatgggggcgcacactgtgtgcttgggggtgctgcttgtttaccacacatgaccagactcccagcaggacagagctgctcagtactttacagaaaccaactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaaagtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctcggtgaggatgcagttctaggcacagcccctgggacagccagctgcctcccagaccacgtcagcctgctccagggtcctcagtcaccctgggccaggggccacgtgtcccatggatgtcgaccatgccaacgtcacattccagcaccccttttgcttgatggcgtctggtggtagtcagcatggtggacccacatcctacagccagaggtgatgttggacaaaggaaggggagtctggatgggtccttaaacgaccattctgtccgcagcggggtcattccttgtcagcccaagggagggccggggagtacactgatcccaacagctgggctgacacctcctttctcccctgcacggggaggattggcctgaggaccgtcaccctgtgcacagccccagtagggtggcagtgccactgtctccttgggccgttgcaggattgggcgggtgcagactccccttgcgggccccttgctcaatccccggccctcccagactcctccctctactgggggtaatttgtgtgtcagaagggctctggcagagctgtaaaatactgttttttaaaaattttagtccagatctttacttattagactgcagaaggagagctagggagagtgggggaagcccccttgcttttgtatctgtgaggtgaatgagggtctgtcacccaaatctacttctcagcccatgaccatagttctgttttccgtttgcaaatctcagtagctctgttttctccaaagtagaatgtgcgcaccggggtcctagccaggcgaggtcagtgtcggcaggctacctggtcattattgctgcctcgtccaggctgatgctgatggtcacaggcacggtggcatcagggagccgggccagcaggcggcgtgaggcggggccagcagctcactgcaagggcattttccacctgatcctggtgtgccccacatgcggtggcagggcagacgtgtgaagcctcggccgtctcggggctggcaggtgtgcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcagtgtcgacgctgcacagcatctgcagattcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctcaaaaatgatca

SEQ ID NO: 298539 - DNA, 7184 bp, Homo sapiens
  misc_feature (3207)..(3207): n is a, c, g, or t
  misc_feature (3998)..(3998): n is a, c, g, or t
attcaatcagccgctgcactttgcctcaccctaattactggaagagattctgagaaacactgtttatagcattccctattaaattaggactggctgggtatggtgactcacacctctaatcccaactctttgagaggctgaggtagtaggatcactttaggccaggagtttgagaccagcctgggcaacatagcaagaccctatctctaaaaaaattatttttttaaagcctaaccagacatggtggtggcatgtacctgtaggcctagcttactcaagaggctgaagtgggaggatcacttgagcccaggaggtcaaggctgcagtgagctatgattgcaccactgcactccagcctggggacagagcaagaccctgtctctagaggggaaaaaaaagaaagaaagaaaagtaccaggactgtcattttctgtgtgaagggatttttttcttctgaaactctgtcaataagctaacagaaggcctatattgtgaaaatttaattgatattgttgttaattaatatgaaaaccacttttggttacattaattaaagaatttcttttttaggtttccttgttgcagaatgaaagtgtagaaaaaaacaagagcatacaaagtttgcacaatcagatatgtagctttgaaattgaaattgagagacaaaaggaaatgcttcgaaataatgaatccaaaatccttcatttacagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggacgagctctctgttgctgacagcaccggccttcggtctccatgtcaggggtgggcgggtgactgctgagggaggcccgcaggtgtgtttctccatcccgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtntgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcacacactttgtccttgaacctgagtgatgggggtcnttgaggatgggatggcctgtgtcacgcgctttgtctttgtgtttggttgtatcggggtctctgttctgagtgtgtcttcctctcatgtactcaacacagtgggcagcagcctgggacggcgtcccctctcccggcggcgggcaagccttgcgctgctccaccctcggcctgggcaccctcacttggcgctggccacctgggccagcctggggccatggtctctctgcagctgaggcccagtggccccttgggcagtgatcggccctccccgcatcacagggccctggcagcaagcgggaaatgggggcgcacactgtgtgcttgggggtgctgcttgtttaccacacatgaccagactcccagcaggacagagctgctcagtactttacagaaaccaactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaaagtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctcggtgaggatgcagttctaggcacagcccctgggacagccagctgcctcccagaccacgtcagcctgctccagggtcctcagtcaccctgggccaggggccacgtgtcccatggatgtcgaccatgccaacgtcacattccagcaccccttttgcttgatggcgtctggtggtagtcagcatggtggacccacatcctacagccagaggtgatgttggacaaaggaaggggagtctggatgggtccttaaacgaccattctgtccgcagcggggtcattccttgtcagcccaagggagggccggggagtacactgatcccaacagctgggctgacacctcctttctcccctgcacggggaggattggcctgaggaccgtcaccctgtgcacagccccagtagggtggcagtgccactgtctccttgggccgttgcaggattgggcgggtgcagactccccttgcgggccccttgctcaatccccggccctcccagactcctccctctactgggggtaatttgtgtgtcagaagggctctggcagagctgtaaaatactgttttttaaaaattttagtccagatctttacttattagactgcagaaggagagctagggagagtgggggaagcccccttgcttttgtatctgtgaggtgaatgagggtctgtcacccaaatctacttctcagcccatgaccatagttctgttttccgtttgcaaatctcagtagctctgttttctccaaagtagaatgtgcgcaccggggtcctagccaggcgaggtcagtgtcggcaggctacctggtcattattgctgcctcgtccaggctgatgctgatggtcacaggcacggtggcatcagggagccgggccagcaggcggcgtgaggcggggccagcagctcactgcaagggcattttccacctgatcctggtgtgccccacatgcggtggcagggcagacgtgtgaagcctcggccgtctcggggctggcaggtgtgcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcagtgtcgacgctgcacagcatctgcagattcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctcaaaaatgatca

SEQ ID NO: 298540 - DNA, 7366 bp, Homo sapiens
  misc_feature (3389)..(3389): n is a, c, g, or t
  misc_feature (4180)..(4180): n is a, c, g, or t
ggggtctgaggagtgggagtcttctcctgggaccctggggtcgttctggggaaccccctgcagccacagagacaggactgtgcttctgccccagacccagcagcagggtaggaggcctttagacgttccaagggaagatgaggccacatgggcatgattctggcatcctaaacctgagaccctgtggcagccatgcagggccacctgtcccgtgggacctgcacttacaggggtgaggcctctctgggaagcagggaccctctgtattatggcccccgaggtatacgagggctgcagaggagatgtccatgggagccttgtggccccgcacaggtgctgtggcctgggagaagagctgggagggacacatgggagtgtgagggtgaggtcggatcctggtatctgaacaggagagctggtggggttggctgatgccagggtgtgggtgtgtgagaaacaggcgggcaggcggcaccagtgccactgtgaaacagggaagcctgctgtgggcagcagaagcatgagctgctgcctgccccagagacagtggagacctctcccctggtcttctgaacacttgccacctgtcactttgctttcctgatggctctctgttgacaaagcaagctgacttagtggagcctcctgttgttttcttccatgtggcttcatgtcacctcgagtgctccctgccggcacaagcacttgatcccagggagctcccaggaggcctgatgcagagccccactcctggagtcagagccgcgggtggcaggcctcatacaggggcctctgactgttctgctcctagcctgtctgtatttgatggaaggtggtgcagcattttccgagtcctaactgtgttttgctttttaacacctttggtttggaagcgagtgatagacagccaagcagagaaactgaaggagcttgacaaggagatccggcccttccggcagaactgggaggaagcagacagcatgaagagcagcgtggagtccctccagaaccgcgtgaccgagctggagagcgtggacaagagcgcggggcaagtggctcggaacacaggcctgctggagtcccagctgagccggcatgaccagatgctgagtgtgcacgacatccgcctagccgacatggacctgcgcttccaggtcctggagaccgccagctacaatggagtgctcatctggaagattcgcgactacaagcggcggaagcaggaggccgtcatggggaagaccctgtccctttacagccagcctttctacactggttactttggctataagatgtgtgccagggtctacctgaacggggacgggatggggaaggggacgcacttgtcgctgttttttgtcatcatgcgtggagaatatgatgccctgcttccttggccgtttaagcagaaagtgacactcatgctgatggatcaggggtcctctcgacgtcatttgggagatgcattcaagcccgaccccaacagcagcagcttcaagaagcccactggagagatgaatatcgcctctggctgcccagtctttgtggcccaaactgttctagaaaatgggacatatattaaagatgatacaatttttattaaagtcatagtggatacttcggatctgcccgatccctgataagtagctggggaggtggatttagcagaaggcaactcctctgggggatttgaaccggtctgtcttcactgaggtcctcgcgctcagaaaaggaccttgtgagacggaggaagcggcagaaggcggacgcgtgccggcgggaggagccacgcgtgagcacacctgacacgttttataatagactagccacacttcactctgaagaattatttatccttcaacaagataaatattgctgtcagagaaggttttcattttcatttttaaagatctagttaattaaggtggaaaacatatatgctaaacaaaagaaacatgatttttcttccttaaacttgaacaccaaaaaaacacacacacacacacacgtggggatagctggacatgtcagcatgttaagtaaaaggagaatttatgaaatagtaatgcaattctgatatcttctttctaaaattcaagagtgcaattttgtttcaaatacagtatattgtctatttttaaggcctcatctggtctctgttttaataatttgtttgtcagaagaccctgaagtatatacctaggtcttttttttgaaagtctctaaattcagaatcattttttaatttaaagttctacaaataattgttactgcaaacattttattttaaaacgttgatagactgatatttcttggaagaaaatataaaatatcaaacactggttatcacttgtgataggaaagagaatattcaacctgttgttatttctcgttagaaatgtaaaccttcaaatatctgtcgtagttaatgacacgacttcacaattctgaacggagcctcgctcatggatgctgtgcatcattttcagatttataattgttttcaccctaaaatagggcatccgttgaactttggagttctaaacaaaatcctgtaggtgtttggattctgccccatgtgttcggacgagctctctgttgctgacagcaccggccttcggtctccatgtcaggggtgggcgggtgactgctgagggaggcccgcaggtgtgtttctccatcccgtcatcttgctgcatgccgtcaacggtctccgaaagcaacgttgtgcgtagagctggtggcatacggcccacgtgccttagatgggacatgctgcttctccaccctgggtttgcattgagcatcattctagaaagtgctagtttaaccagacttttctctccaccactagatctttgtctctacaagggccctcagacacctctgcacctgctgaggggaagccaggctccaccgtcggcttctggagcctccgctgcttaattaccacagattccaaatctctaggccccacgagtgagccgcctggtccaagtacggcctggtcccaccctgagggaggcaggtgtggaacagaagccgagcctctccgtgtccccaccggggccgtgggcacccccacagcccgaagcagaaccctctgagcattccagagaccgctgctcgggggcctgcccaggctgaccaacgggcgctcctgaccaccaccctggcgggaagggtggccacggggcccgtcgtcccagcctgtgcctgcccagatggcattttctcaactcactgtttactgtctctcagtgtccaactgtgattagaagcctggagcctgccccctgcaccccttttgctatgcaccacgcttcatggtgctcttaccactgatgggtgctacacgcgacgggtgcttcttaggcaaaaccaatgtntgcgaactgtcacacctgtgccactcgcccacaagccgcgcccacaattggccagctgggccgtgcacgtcagactgcctgcctcggctctccccgtggccgcgcggggacagcttggtgggtgcccggtggcccacctgtctctggtgctgccatctgtcctgggtgtgccttcgccccagtgcctgctggaagtgccctccgtcgcacccctgtgccctgagctcccgtgaggggcccgccgcgccctttcgcggtcgaagcgttccgttgttcttatctgcctttcctttccccgctctcctgggattactttgggggaatgagtatccttggttctgccctgtgagggagtcgtgtgtccctgctcataaaggaaggacttcctgcagaagctgcggaaaactactgttccctcgaaggtgtcccccacctgaggcctgtcccctacctgccctcaggtagttttcctgaggccaggggttaacaacagggacatccctgcaacttccccttcacaaaatgtataatattagatgaaggatatgcaacatcttggtctagtaagaaccgtttcctcccctctgggttgaagtcctggtgtggcccccagaagcagcagtgcgtgtcactgggacgtctccagtagcccttcccaggcagacgctcctggcgggacgccatggggcccacctgagggtcccacagacgtaacctgagtgacaggagtccttgaggatgggatggcctatgtcacacactttgtccttgaacctgagtgatgggggtcnttgaggatgggatggcctgtgtcacgcgctttgtctttgtgtttggttgtatcggggtctctgttctgagtgtgtcttcctctcatgtactcaacacagtgggcagcagcctgggacggcgtcccctctcccggcggcgggcaagccttgcgctgctccaccctcggcctgggcaccctcacttggcgctggccacctgggccagcctggggccatggtctctctgcagctgaggcccagtggccccttgggcagtgatcggccctccccgcatcacagggccctggcagcaagcgggaaatgggggcgcacactgtgtgcttgggggtgctgcttgtttaccacacatgaccagactcccagcaggacagagctgctcagtactttacagaaaccaactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaaagtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctcggtgaggatgcagttctaggcacagcccctgggacagccagctgcctcccagaccacgtcagcctgctccagggtcctcagtcaccctgggccaggggccacgtgtcccatggatgtcgaccatgccaacgtcacattccagcaccccttttgcttgatggcgtctggtggtagtcagcatggtggacccacatcctacagccagaggtgatgttggacaaaggaaggggagtctggatgggtccttaaacgaccattctgtccgcagcggggtcattccttgtcagcccaagggagggccggggagtacactgatcccaacagctgggctgacacctcctttctcccctgcacggggaggattggcctgaggaccgtcaccctgtgcacagccccagtagggtggcagtgccactgtctccttgggccgttgcaggattgggcgggtgcagactccccttgcgggccccttgctcaatccccggccctcccagactcctccctctactgggggtaatttgtgtgtcagaagggctctggcagagctgtaaaatactgttttttaaaaattttagtccagatctttacttattagactgcagaaggagagctagggagagtgggggaagcccccttgcttttgtatctgtgaggtgaatgagggtctgtcacccaaatctacttctcagcccatgaccatagttctgttttccgtttgcaaatctcagtagctctgttttctccaaagtagaatgtgcgcaccggggtcctagccaggcgaggtcagtgtcggcaggctacctggtcattattgctgcctcgtccaggctgatgctgatggtcacaggcacggtggcatcagggagccgggccagcaggcggcgtgaggcggggccagcagctcactgcaagggcattttccacctgatcctggtgtgccccacatgcggtggcagggcagacgtgtgaagcctcggccgtctcggggctggcaggtgtgcgggtgaggaggccccggtggccaagcagagcctgcgtttcatttctcctgctgcactgtgtctagtctgtcttgtgaactctcaccgtgaaaagaggctagaagtccaggatcgctgtaccgctcctgtaattaggtgatgactggatttgacaacttagtcccctcagacaagtaagataccctccaacagcaaattcaatgacttaattggaaaacacacaagctggcatgatgtccggtgatttctgtaagaaatgcctgtaggagaaggtctgtgaagtgtggagggcagtgtcgacgctgcacagcatctgcagattcgcagcctcttctctgccggtgcctctgttcggttctgttacccaaaaacaaagaccaaagaaggccaatctctcatttgaccctgtctttttaatctgcctgttttaaaagttgcgtctgtagtagccgcttgctgtgaagacacatcttgacagtccaagtgattttgtgaccagtgatttgggtcctgttttccgctcttctaagaaaaaacaaaaagaccgtgagttattgcccagcaataatcatgttgttactgtgagttagcaacatgcctgacttcctgatagcattactgttttctagttttgtttattgtatattatgtgtggttttatttggtatttatttgtgttttgaggtcttgcaatgtttttgtgtttctgatgctaataactaaagtttgtaagactgtagaatgcaaaactcggagatgctaaactgtcttattagaggaaaataaatctgattatggagtctcaaaaatgatca

SEQ ID NO: 298541 - DNA, 1078 bp, Homo sapiens
cgggggagcgcggcgcggccgccgcgtgcgcgagccggggttgcagcccagccgggactttccagccggcggcagccgcggcggccgccggctcttccccgccccccgccatggggcagcccggggagcagaacgctgcggaccgcggcggaggacgcgcccggcgcccctgagccggccgagcggcgacggaccgcgagatgaggaaaatgaggcccaaagaagtgatgccacttggttaaggtcccagagcaggtcagaatcagacctaggatcagaaacctggctcctggctcctggctccctactcttctaaggatcgctgtcctgacagaagagaactcctctttcctaaaatggagtcgagtaaaaagatggactctcctggcgcgctgcagactaacccgccgctaaagctgcacactgaccgcagtgctgggacgccagtttttgtccctgaacaaggaggttacaaggaaaagtttgtgaagaccgtggaggacaagtacaagtgtgagaagtgccacctggtgctgtgcagcccgaagcagaccgagtgtgggcaccgcttctgcgagagctgcatggcggccctgctgagctcttcaagtccaaaatgtacagcgtgtcaagagagcatcgttaaagataaggtgtttaaggataattgctgcaagagagaaattctggctcttcagatctattgtcggaatgaaagcagaggttgtgcagagcagttaacgctgggacatctgctggtgcatttaaaaaatgattgccattttgaagaacttccatgtgtgcgtcctgactgcaaagaaaaggtcttgaggaaagacctgcgagaccacgtggagaaggcgtgtaaataccgggaagccacatgcagccactgcaagagtcaggttccgatgatcgcgctgcaggtgcgggtcctcccattccacaggccttccactcaattcctatatgatacattccacaggccttccgctcaattcgtagataatccgttccacaggccttccctcaactcatagataatccgttccacaggccttccactcagttcatagat

SEQ ID NO: 298542 - DNA, 384 bp, Homo sapiens
caggtggccctgagcacagccctccttaggcgcagagattccctgttcacttgacgcaaataggtctcccctctttgtgtttagtgctgcttttagggtcgtatgttagccgttctgccctttgaaatgcagcgaggttcgctgaatgcctcacatgtttgctctcgcaggggacaaaccagcagatcaaggcccacgaggccagctccgccgtgcagcacgtcaacctgctgaaggagtggagcaactcgctcgaaaagaaggtgggctgcacactttcctgctgctatgggatttgtatcatctcttcagattatttaaagacaaaacctttttgtagttattaatgggttttggataaaagaaactatcaagagaatgtca

SEQ ID NO: 298543 - DNA, 690 bp, Homo sapiens
tactgagccactcatatatgccagacactgtgctaggagtgtgtgaaagccagagaaatactcattagaggaaaattgctgacctgaagccataccatatgaccttattagcacaactcagtgtattcgataatgaaaatgttcactgactttgattttggaaatcccccctacagagtagcataaacgagacattgatattgtctcttttctcatttaaagctatgcctttaaaggccacccatgttgctgtatatacttggaatgtgtttccacattttaccagtccgcttctccagcgataggaacctagaatgcttctaattcctgtaatcacagatgtagcttcagggtatatcttcatacatgttgttcatacgggaatttctttgctatctatgcccaaaagtaggattgctagatcatgagatgtgcaaatagtttgcctaagtagtgctgccggactgttcttccgaacagttactccactctgcaatcccaccagcagtgccagttccaaaaaagaactcactgacacttggtgttatccagctttcttattctaccaaactgatagcataatgtgatcatattgttcatgccttgggattttctcttctataatttggatatctttgtccattgctcatttctttattgaagttgctttcttaaaaattgatttaactt

SEQ ID NO: 298544 - DNA, 1047 bp, Homo sapiens
cagaacagacgtttgaacagagcaggcttctgaggtctccaaaatgcctgtcccagcctcctggccccatcctcctggtcctttcctgcttctgactctactgctgggacttacagaagtggcaggtgaggaggagctacagatgattcagcctgagaagctcctgttggtcacagttggaaagacagccactctgcactgcactgtgacctccctgcttcccgtgggacccgtcctgtggttcagaggagttggaccaggccgagaattaatctacaatcaaaaagaaggccacttccccagggtaacaacagtttcagacctcacaaagagaaacaacatggacttttccatccgcatcagtagcatcaccccagcagatgtcggcacatactactgtgtgaagtttcgaaaagggagccctgagaacgtggagtttaagtctggaccaggcactgagatggctttgggtggcccggcatcatctcttactgcgctgctcctcatagctgtcctcctgggccccatctacgtcccctggaagcagaagacctgactctccttccttcctcccctgccacgtgggaccctcatctctgctgcctccttcctttcctgagaggctcagcttgagagaatgagccagtgagaagcttctctagacttggctccaaacatctcccctcccaagacatctgcctgcccacaggctcctgttgctccttcacacagacctggatgccccagagcaaggtcttcattcatggtcctgagcaggggccatgggattgggctctgggcactgacttaacggcacctccctagaaggcgagaaacatgccaaatctaaacacaccaggactcccatccatcgccttgagactgaccgtaaaccacagacgctctccaggttctcaagagttatcctgccttccagattcctgcctatcccaactccccagccttgttgaggttctctattgcctcttgaatacaaatgcactcccaaagtggttttaagaaaataaaaagattatccttccaaac

SEQ ID NO: 298545 - DNA, 806 bp, Homo sapiens
gtttccctagcagaatggaatgacaatccctgctcccataggcttgtgagggtcaagtgaggaaccccgttgccacatgtatgaatacctgagtacacaccccctccacctcttccctccaggagaataagctggcaacctgggacaggatgagtgagaatggggagcctctttctgtggcttctgccttgtgctggagtgaagatagcctgggcaggatgcaggttcaaaggcccggcatcatctcttactgcgctgctcctcatagctgtcctcctgggccccatctacgtcccctggaagcagaagacctgactctccttccttcctcccctgccacgtgggaccctcatctctgctgcctccttcctttcctgagaggctcagcttgagagaatgagccagtgagaagcttctctagacttggctccaaacatctcccctcccaagacatctgcctgcccacaggctcctgttgctccttcacacagacctggatgccccagagcaaggtcttcattcatggtcctgagcaggggccatgggattgggctctgggcactgacttaacggcacctccctagaaggcgagaaacatgccaaatctaaacacaccaggactcccatccatcgccttgagactgaccgtaaaccacagacgctctccaggttctcaagagttatcctgccttccagattcctgcctatcccaactccccagccttgttgaggttctctattgcctcttgaatacaaatgcactcccaaagtggttttaagaaaataaaaagattatccttccaaac

SEQ ID NO: 298546 - DNA, 716 bp, Homo sapiens
ctctcattgtgaagccatcctcaagccacctgcctacccttttatagtcattaaaatgtccctaggaatttggacttgttttgttccaaaggacatggtctcagggatcaacctaaggaacactagtgatgagcttctttaggcccggcatcatctcttactgcgctgctcctcatagctgtcctcctgggccccatctacgtcccctggaagcagaagacctgactctccttccttcctcccctgccacgtgggaccctcatctctgctgcctccttcctttcctgagaggctcagcttgagagaatgagccagtgagaagcttctctagacttggctccaaacatctcccctcccaagacatctgcctgcccacaggctcctgttgctccttcacacagacctggatgccccagagcaaggtcttcattcatggtcctgagcaggggccatgggattgggctctgggcactgacttaacggcacctccctagaaggcgagaaacatgccaaatctaaacacaccaggactcccatccatcgccttgagactgaccgtaaaccacagacgctctccaggttctcaagagttatcctgccttccagattcctgcctatcccaactccccagccttgttgaggttctctattgcctcttgaatacaaatgcactcccaaagtggttttaagaaaataaaaagattatccttccaaac

SEQ ID NO: 298547 - DNA, 1736 bp, Homo sapiens
aagcatgatgggttttactagaacgtttcagtgtcactaagtcacagaagaggaggacaagaagaggaattatggcagggaccagctttatcacagtggtgtgcctggtttggcagggtgctcacaacttgtttgtgggatgtggaggtatcagaagtggcaggtgaggaggagctacagatgattcagcctgagaagctcctgttggtcacagttggaaagacagccactctgcactgcactgtgacctccctgcttcccgtgggacccgtcctgtggttcagaggagttggaccaggccgagaattaatctacaatcaaaaagaaggccacttccccagggtaacaacagtttcagacctcacaaagagaaacaacatggacttttccatccgcatcagtagcatcaccccagcagatgtcggcacatactactgtgtgaagtttcgaaaagggagccctgagaacgtggagtttaagtctggaccaggcactgagatggctttgggtgccaaaccctctgcccccgtggtattgggccctgcggcgaggaccacacctgagcatacagtgagtttcacctgtgagtcccatggcttctctcccagagacatcaccctgaaatggttcaaaaatgggaatgagctctcagacttccagaccaacgtggaccccacaggacagagtgtggcctacagcatccgcagcacagccagggtggtactggacccctgggacgttcgctctcaggtcatctgcgaggtggcccatgtcaccttgcagggggaccctcttcgtgggactgccaacttgtctgaggccatccgagttccacccaccttggaggttactcaacagcccatgagggcggggaaccaggtaaacgtcacctgccaggtgaggaagttctacccccagagcctacagctgacctggttggagaatggaaacgtgtgccagagagaaacagcctcgacccttacagagaacaaggatggtacctacaactggacaagctggttcctggtgaacatatctgaccaaagggatgatgtggtcctcacctgccaggtgaagcatgatgggcagctggcggtcagcaaacgccttgccctggaggtcacagtccaccagaaggaccagagctcagatgctacccctggcccggcatcatctcttactgcgctgctcctcatagctgtcctcctgggccccatctacgtcccctggaagcagaagacctgactctccttccttcctcccctgccacgtgggaccctcatctctgctgcctccttcctttcctgagaggctcagcttgagagaatgagccagtgagaagcttctctagacttggctccaaacatctcccctcccaagacatctgcctgcccacaggctcctgttgctccttcacacagacctggatgccccagagcaaggtcttcattcatggtcctgagcaggggccatgggattgggctctgggcactgacttaacggcacctccctagaaggcgagaaacatgccaaatctaaacacaccaggactcccatccatcgccttgagactgaccgtaaaccacagacgctctccaggttctcaagagttatcctgccttccagattcctgcctatcccaactccccagccttgttgaggttctctattgcctcttgaatacaaatgcactcccaaagtggttttaagaaaataaaaagattatccttccaaac

SEQ ID NO: 298548 - DNA, 630 bp, Homo sapiens
  misc_feature (39)..(39): n is a, c, g, or t
gtgacatacacaaccaacagttatacacgacggtcaacnaaaaaacgccacttgaggcccggcatcatctcttactgcgctgctcctcatagctgtcctcctgggccccatctacgtcccctggaagcagaagacctgactctccttccttcctcccctgccacgtgggaccctcatctctgctgcctccttcctttcctgagaggctcagcttgagagaatgagccagtgagaagcttctctagacttggctccaaacatctcccctcccaagacatctgcctgcccacaggctcctgttgctccttcacacagacctggatgccccagagcaaggtcttcattcatggtcctgagcaggggccatgggattgggctctgggcactgacttaacggcacctccctagaaggcgagaaacatgccaaatctaaacacaccaggactcccatccatcgccttgagactgaccgtaaaccacagacgctctccaggttctcaagagttatcctgccttccagattcctgcctatcccaactccccagccttgttgaggttctctattgcctcttgaatacaaatgcactcccaaagtggttttaagaaaataaaaagattatccttccaaac

SEQ ID NO: 298549 - DNA, 3489 bp, Homo sapiens
cttcttctttacctccgccttgttcctgtcctcaccacacggactgagactgatttgattaaagcaccagagtgtaatggccctcagagcagggctggtcctggggttccacaccctgatgaccctcctgagcccgcaggaggcaggggccaccaaggctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacacacacacattcttgctctacccaaagctctggctggcagcactaaatgctttggtggtgtttgcactgtgtcctttccaggccttggccagttcttccaggggtgaggcatgtggtgctggggattggcagccatcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaggacaggctcatggggactccactcctgcctgggtttactctgtatgaagaggccactggtatcctgccatgatgttatctcctttttctactttccctagagtcccatgcatgataaagagaggcccaaggcttggataaggtggccacttccctcagtggagtcagtcatgttaggtaggaggtggtagagtcggtctgcaaggtatctcgtaagaggggaggtccacctagacacactctaaatatgtggcctagaagattttggtctacttttctgtgaacagaatttaaaacatacaaagagataaatcaccataccacatagtttatgtcaagaccaaaatgagcaatacagattacggttttcaaaccagaatgcacataagaactgcttgggatccttttaaaagtacaggcattggcctggtgcagtggctcattcctgtaatcccagcactttgggaggccaaggggacaggactgcttgaggccaagaggtggaaaccatcttgggctacatagagagaccccatctctacaaagaaagatttaaaaattaaccagccatggtggctcgcacctgtattcccagccactggggaggctgaggccggaggagtgcttgagcccaggagttcaaggctgcagtgagccaagattgcgccactgcactccagcctaggtgacagagtgagaccctgtctctaaataaataaataaataaaatataaaaataacagtcatcacccagacctactgaattagaatctcgggagtgcagggggcagcaacaggggggctgtcttttctgagaaggggtctcactctgtcaccaggctggagtgccatggcatgatctcagctcactgcaacctccacctcctgagttcaagccattctcctgcctcagcctcctgagtagctgggactacaggtgtgcgccactacactcagctaatttttgtattttaagtagagacggggtttcatcatgttggccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccatcgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagagaataagttgaaatcaatgaccagaagaccctgatggaagtggaggagaatcatctcaggcaaactttttgtgtgccagtaacagaaaccctctttgtgtgatcacatgcaaagtataggatatttgcaatatagccatggggaggagtgcagggcccaagggtagattttagccaggcctcccaggaacagaactcggatccgaaaagcccagagaagctagagctgcccctccaacactctcggatccacatggtctgtgttctctagacccccctgcatgttagcggtgttctctctctgtggactgactgtccttctcagtgaacatgtccacccgacagctcctgagtttatatcatctcaaccctcacaacccacagaggctgtgtctcctagtcacagctttaaattactggaaaaataaatgactggccaaacttggagcaggtgtccatcccagccctgtgtagttagagcaggaatcaagatctcaacacaaatgtggctgccaagcactcagccccggggcgaggggtcaagttcttctcagagaaagaggaataagttggttctcagaagacatcacaagatacgtgtgtacccaacaatctctgatctctgctgatcttttgcttagacgttaacttgatgcatcattggaaaggtgtttctctcatctctgtcctaaggcttgataaagtcattaaaattgtgttcttttgactaaagaaaa

SEQ ID NO: 298550 - DNA, 3018 bp, Homo sapiens
cttcttctttacctccgccttgttcctgtcctcaccacacggactgagactgatttgattaaagcaccagagtgtaatggccctcagagcagggctggtcctggggttccacaccctgatgaccctcctgagcccgcaggaggcaggggccaccaaggctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacacacacacattcttgctctacccaaagctctggctggcagcactaaatgctttggtggtgtttgcactgtgtcctttccaggccttggccagttcttccaggggtgaggcatgtggtgctggggattggcagccatcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaggacaggctcatggggactccactcctgcctgggtttactctgtatgaagaggccactggtatcctgccatgatgttatctcctttttctactttccctagagtcccatgcatgataaagagaggcccaaggcttggataaggtggccacttccctcagtggagtcagtcatgttaggtaggaggtggtagagtcggtctgcaaggtatctcgtaagaggggaggtccacctagacacactctaaatatgtggcctagaagattttggtctacttttctgtgaacagaatttaaaacatacaaagagataaatcaccataccacatagtttatgtcaagaccaaaatgagcaatacagattacggttttcaaaccagaatgcacataagaactgcttgggatccttttaaaagtacaggcattggcctggtgcagtggctcattcctgtaatcccagcactttgggaggccaaggggacaggactgcttgaggccaagaggtggaaaccatcttgggctacatagagagaccccatctctacaaagaaagatttaaaaattaaccagccatggtggctcgcacctgtattcccagccactggggaggctgaggccggaggagtgcttgagcccaggagttcaaggctgcagtgagccaagattgcgccactgcactccagcctaggtgacagagtgagaccctgtctctaaataaataaataaataaaatataaaaataacagtcatcacccagacctactgaattagaatctcgggagtgcagggggcagcaacaggggggctgtcttttctgagaaggggtctcactctgtcaccaggctggagtgccatggcatgatctcagctcactgcaacctccacctcctgagttcaagccattctcctgcctcagcctcctgagtagctgggactacaggtgtgcgccactacactcagctaatttttgtattttaagtagagacggggtttcatcatgttggccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccatcgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagagaataagttgagaatcaagatctcaacacaaatgtggctgccaagcactcagccccggggcgaggggtcaagttcttctcagagaaagaggaataagttggttctcagaagacatcacaagatacgtgtgtacccaacaatctctgatctctgctgatcttttgcttagacgttaacttgatgcatcattggaaaggtgtttctctcatctctgtcctaaggcttgataaagtcattaaaattgtgttcttttgactaaagaaaa

SEQ ID NO: 298551 - DNA, 3173 bp, Homo sapiens
cttcttctttacctccgccttgttcctgtcctcaccacacggactgagactgatttgattaaagcaccagagtgtaatggccctcagagcagggctggtcctggggttccacaccctgatgaccctcctgagcccgcaggaggcaggggccaccaaggctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacacacacacattcttgctctacccaaagctctggctggcagcactaaatgctttggtggtgtttgcactgtgtcctttccaggccttggccagttcttccaggggtgaggcatgtggtgctggggattggcagccatcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaggacaggctcatggggactccactcctgcctgggtttactctgtatgaagaggccactggtatcctgccatgatgttatctcctttttctactttccctagagtcccatgcatgataaagagaggcccaaggcttggataaggtggccacttccctcagtggagtcagtcatgttaggtaggaggtggtagagtcggtctgcaaggtatctcgtaagaggggaggtccacctagacacactctaaatatgtggcctagaagattttggtctacttttctgtgaacagaatttaaaacatacaaagagataaatcaccataccacatagtttatgtcaagaccaaaatgagcaatacagattacggttttcaaaccagaatgcacataagaactgcttgggatccttttaaaagtacaggcattggcctggtgcagtggctcattcctgtaatcccagcactttgggaggccaaggggacaggactgcttgaggccaagaggtggaaaccatcttgggctacatagagagaccccatctctacaaagaaagatttaaaaattaaccagccatggtggctcgcacctgtattcccagccactggggaggctgaggccggaggagtgcttgagcccaggagttcaaggctgcagtgagccaagattgcgccactgcactccagcctaggtgacagagtgagaccctgtctctaaataaataaataaataaaatataaaaataacagtcatcacccagacctactgaattagaatctcgggagtgcagggggcagcaacaggggggctgtcttttctgagaaggggtctcactctgtcaccaggctggagtgccatggcatgatctcagctcactgcaacctccacctcctgagttcaagccattctcctgcctcagcctcctgagtagctgggactacaggtgtgcgccactacactcagctaatttttgtattttaagtagagacggggtttcatcatgttggccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccatcgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagagaataagttgaaatcaatgaccagaagaccctgatggaagtggaggagaatcatctcaggcaaactttttgtgtgccagtaacagaaaccctctttgtgtgatcacatgcaaagtataggatatttgcaatatagccatggggaggagtgcagggcccaagggtagattttagccaggcctcccaggaacagaactcggatccgaaaagcccagagaagctagagctgcccctccaacactctcggatccacatggtctgtgttctctagacccccctgcatgttagcggtgttctctctctgtggactgactgtccttctcagtgaacatgtccacccgacagctcctgagtttatatcatctcgtctcttctcttgtacatctcgtctcttctcttgtacatctcgtctcttctcttg

SEQ ID NO: 298552 - DNA, 3632 bp, Homo sapiens
cttcttctttacctccgccttgttcctgtcctcaccacacggactgagactgatttgattaaagcaccagagtgtaatggccctcagagcagggctggtcctggggttccacaccctgatgaccctcctgagcccgcaggaggcaggggccaccaaggggccagcccagtgtcagaacaggactctgtccccacacagaacccaggacggggcccaggctcagggactcaacaatcacatattgtggatgagacagacacatttttttctctctccttgaccctgaactcgccaaacacagctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacacacacacattcttgctctacccaaagctctggctggcagcactaaatgctttggtggtgtttgcactgtgtcctttccaggccttggccagttcttccaggggtgaggcatgtggtgctggggattggcagccatcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaggacaggctcatggggactccactcctgcctgggtttactctgtatgaagaggccactggtatcctgccatgatgttatctcctttttctactttccctagagtcccatgcatgataaagagaggcccaaggcttggataaggtggccacttccctcagtggagtcagtcatgttaggtaggaggtggtagagtcggtctgcaaggtatctcgtaagaggggaggtccacctagacacactctaaatatgtggcctagaagattttggtctacttttctgtgaacagaatttaaaacatacaaagagataaatcaccataccacatagtttatgtcaagaccaaaatgagcaatacagattacggttttcaaaccagaatgcacataagaactgcttgggatccttttaaaagtacaggcattggcctggtgcagtggctcattcctgtaatcccagcactttgggaggccaaggggacaggactgcttgaggccaagaggtggaaaccatcttgggctacatagagagaccccatctctacaaagaaagatttaaaaattaaccagccatggtggctcgcacctgtattcccagccactggggaggctgaggccggaggagtgcttgagcccaggagttcaaggctgcagtgagccaagattgcgccactgcactccagcctaggtgacagagtgagaccctgtctctaaataaataaataaataaaatataaaaataacagtcatcacccagacctactgaattagaatctcgggagtgcagggggcagcaacaggggggctgtcttttctgagaaggggtctcactctgtcaccaggctggagtgccatggcatgatctcagctcactgcaacctccacctcctgagttcaagccattctcctgcctcagcctcctgagtagctgggactacaggtgtgcgccactacactcagctaatttttgtattttaagtagagacggggtttcatcatgttggccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccatcgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagagaataagttgaaatcaatgaccagaagaccctgatggaagtggaggagaatcatctcaggcaaactttttgtgtgccagtaacagaaaccctctttgtgtgatcacatgcaaagtataggatatttgcaatatagccatggggaggagtgcagggcccaagggtagattttagccaggcctcccaggaacagaactcggatccgaaaagcccagagaagctagagctgcccctccaacactctcggatccacatggtctgtgttctctagacccccctgcatgttagcggtgttctctctctgtggactgactgtccttctcagtgaacatgtccacccgacagctcctgagtttatatcatctcaaccctcacaacccacagaggctgtgtctcctagtcacagctttaaattactggaaaaataaatgactggccaaacttggagcaggtgtccatcccagccctgtgtagttagagcaggaatcaagatctcaacacaaatgtggctgccaagcactcagccccggggcgaggggtcaagttcttctcagagaaagaggaataagttggttctcagaagacatcacaagatacgtgtgtacccaacaatctctgatctctgctgatcttttgcttagacgttaacttgatgcatcattggaaaggtgtttctctcatctctgtcctaaggcttgataaagtcattaaaattgtgttcttttgactaaagaaaa

SEQ ID NO: 298553 - DNA, 3917 bp, Homo sapiens
cttcttctttacctccgccttgttcctgtcctcaccacacggactgagactgatttgattaaagcaccagagtgtaatggccctcagagcagggctggtcctggggttccacaccctgatgaccctcctgagcccgcaggaggcaggggccaccaaggggccagcccagtgtcagaacaggactctgtccccacacagaacccaggacggggcccaggctcagggactcaacaatcacatattgtggatgagacagacacatttttttctctctccttgaccctgaactcgccaaacacagctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacggaggctccaggtcttcccagacccctttggcacccctctccttgaggaatgacacctctcacccggactcccgcccagggaccagtcaaatataggagctcctggcgtccccactccctccccagtctcctctccctctgtttccctcctctcctgccccagtggataccccagagcatcccctgcccacagatggctacaaagggggaacgtcccttaatcccagtcctagtaaggccctggggtgagggatgagcctgtggactcagggcccgttcctcctagtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacacacacacattcttgctctacccaaagctctggctggcagcactaaatgctttggtggtgtttgcactgtgtcctttccaggccttggccagttcttccaggggtgaggcatgtggtgctggggattggcagccatcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaggacaggctcatggggactccactcctgcctgggtttactctgtatgaagaggccactggtatcctgccatgatgttatctcctttttctactttccctagagtcccatgcatgataaagagaggcccaaggcttggataaggtggccacttccctcagtggagtcagtcatgttaggtaggaggtggtagagtcggtctgcaaggtatctcgtaagaggggaggtccacctagacacactctaaatatgtggcctagaagattttggtctacttttctgtgaacagaatttaaaacatacaaagagataaatcaccataccacatagtttatgtcaagaccaaaatgagcaatacagattacggttttcaaaccagaatgcacataagaactgcttgggatccttttaaaagtacaggcattggcctggtgcagtggctcattcctgtaatcccagcactttgggaggccaaggggacaggactgcttgaggccaagaggtggaaaccatcttgggctacatagagagaccccatctctacaaagaaagatttaaaaattaaccagccatggtggctcgcacctgtattcccagccactggggaggctgaggccggaggagtgcttgagcccaggagttcaaggctgcagtgagccaagattgcgccactgcactccagcctaggtgacagagtgagaccctgtctctaaataaataaataaataaaatataaaaataacagtcatcacccagacctactgaattagaatctcgggagtgcagggggcagcaacaggggggctgtcttttctgagaaggggtctcactctgtcaccaggctggagtgccatggcatgatctcagctcactgcaacctccacctcctgagttcaagccattctcctgcctcagcctcctgagtagctgggactacaggtgtgcgccactacactcagctaatttttgtattttaagtagagacggggtttcatcatgttggccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccatcgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagagaataagttgaaatcaatgaccagaagaccctgatggaagtggaggagaatcatctcaggcaaactttttgtgtgccagtaacagaaaccctctttgtgtgatcacatgcaaagtataggatatttgcaatatagccatggggaggagtgcagggcccaagggtagattttagccaggcctcccaggaacagaactcggatccgaaaagcccagagaagctagagctgcccctccaacactctcggatccacatggtctgtgttctctagacccccctgcatgttagcggtgttctctctctgtggactgactgtccttctcagtgaacatgtccacccgacagctcctgagtttatatcatctcaaccctcacaacccacagaggctgtgtctcctagtcacagctttaaattactggaaaaataaatgactggccaaacttggagcaggtgtccatcccagccctgtgtagttagagcaggaatcaagatctcaacacaaatgtggctgccaagcactcagccccggggcgaggggtcaagttcttctcagagaaagaggaataagttggttctcagaagacatcacaagatacgtgtgtacccaacaatctctgatctctgctgatcttttgcttagacgttaacttgatgcatcattggaaaggtgtttctctcatctctgtcctaaggcttgataaagtcattaaaattgtgttcttttgactaaagaaaa

SEQ ID NO: 298554 - DNA, 3322 bp, Homo sapiens
cttcttctttacctccgccttgttcctgtcctcaccacacggactgagactgatttgattaaagcaccagagtgtaatggccctcagagcagggctggtcctggggttccacaccctgatgaccctcctgagcccgcaggaggcaggggccaccaaggggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattgggagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacacacacacattcttgctctacccaaagctctggctggcagcactaaatgctttggtggtgtttgcactgtgtcctttccaggccttggccagttcttccaggggtgaggcatgtggtgctggggattggcagccatcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaggacaggctcatggggactccactcctgcctgggtttactctgtatgaagaggccactggtatcctgccatgatgttatctcctttttctactttccctagagtcccatgcatgataaagagaggcccaaggcttggataaggtggccacttccctcagtggagtcagtcatgttaggtaggaggtggtagagtcggtctgcaaggtatctcgtaagaggggaggtccacctagacacactctaaatatgtggcctagaagattttggtctacttttctgtgaacagaatttaaaacatacaaagagataaatcaccataccacatagtttatgtcaagaccaaaatgagcaatacagattacggttttcaaaccagaatgcacataagaactgcttgggatccttttaaaagtacaggcattggcctggtgcagtggctcattcctgtaatcccagcactttgggaggccaaggggacaggactgcttgaggccaagaggtggaaaccatcttgggctacatagagagaccccatctctacaaagaaagatttaaaaattaaccagccatggtggctcgcacctgtattcccagccactggggaggctgaggccggaggagtgcttgagcccaggagttcaaggctgcagtgagccaagattgcgccactgcactccagcctaggtgacagagtgagaccctgtctctaaataaataaataaataaaatataaaaataacagtcatcacccagacctactgaattagaatctcgggagtgcagggggcagcaacaggggggctgtcttttctgagaaggggtctcactctgtcaccaggctggagtgccatggcatgatctcagctcactgcaacctccacctcctgagttcaagccattctcctgcctcagcctcctgagtagctgggactacaggtgtgcgccactacactcagctaatttttgtattttaagtagagacggggtttcatcatgttggccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccatcgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagagaataagttgaaatcaatgaccagaagaccctgatggaagtggaggagaatcatctcaggcaaactttttgtgtgccagtaacagaaaccctctttgtgtgatcacatgcaaagtataggatatttgcaatatagccatggggaggagtgcagggcccaagggtagattttagccaggcctcccaggaacagaactcggatccgaaaagcccagagaagctagagctgcccctccaacactctcggatccacatggtctgtgttctctagacccccctgcatgttagcggtgttctctctctgtggactgactgtccttctcagtgaacatgtccacccgacagctcctgagtttatatcatctcaaccctcacaacccacagaggctgtgtctcctagtcacagctttaaattactggaaaaataaatgactggccaaacttggagcaggtgtccatcccagccctgtgtagttagagcaggaatcaagatctcaacacaaatgtggctgccaagcactcagccccggggcgaggggtcaagttcttctcagagaaagaggaataagttggttctcagaagacatcacaagatacgtgtgtacccaacaatctctgatctctgctgatcttttgcttagacgttaacttgatgcatcattggaaaggtgtttctctcatctctgtcctaaggcttgataaagtcattaaaattgtgttcttttgactaaagaaaa

SEQ ID NO: 298555 - DNA, 3584 bp, Homo sapiens
cttcttctttacctccgccttgttcctgtcctcaccacacggactgagactgatttgattaaagcaccagagtgtaatggccctcagagcagggctggtcctggggttccacaccctgatgaccctcctgagcccgcaggaggcaggggccaccaaggctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacgtgcctccacgggtgaccgtgctccccaagtctcgggtggagctgggccagcccaacatcctcatctgcatcgtggacaacatcttcccccctgtgatcaatatcacctggctgcgcaacggccaaactgtcactgagggagtggcccagaccagcttctattcccagcctgaccatttgttccgcaagttccactacctgcccttcgtgccctcagccgaggacgtctatgactgccaggtggagcactggggcctggatgcgccactcctcaggcattggggtacggagccccctccccatgcaccctcctggccccaggtttcctttactctagaatcctttcatataccaccgactccttcctttctctcctagagctccaggtgcctattccaccaccagatgccatggagaccctggtctgtgccctgggcctggccatcggcctggtgggcttcctcgtgggcaccgtcctcatcatcatgggcacatatgtgtccagtgtccccaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacacacacacattcttgctctacccaaagctctggctggcagcactaaatgctttggtggtgtttgcactgtgtcctttccaggccttggccagttcttccaggggtgaggcatgtggtgctggggattggcagccatcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaggacaggctcatggggactccactcctgcctgggtttactctgtatgaagaggccactggtatcctgccatgatgttatctcctttttctactttccctagagtcccatgcatgataaagagaggcccaaggcttggataaggtggccacttccctcagtggagtcagtcatgttaggtaggaggtggtagagtcggtctgcaaggtatctcgtaagaggggaggtccacctagacacactctaaatatgtggcctagaagattttggtctacttttctgtgaacagaatttaaaacatacaaagagataaatcaccataccacatagtttatgtcaagaccaaaatgagcaatacagattacggttttcaaaccagaatgcacataagaactgcttgggatccttttaaaagtacaggcattggcctggtgcagtggctcattcctgtaatcccagcactttgggaggccaaggggacaggactgcttgaggccaagaggtggaaaccatcttgggctacatagagagaccccatctctacaaagaaagatttaaaaattaaccagccatggtggctcgcacctgtattcccagccactggggaggctgaggccggaggagtgcttgagcccaggagttcaaggctgcagtgagccaagattgcgccactgcactccagcctaggtgacagagtgagaccctgtctctaaataaataaataaataaaatataaaaataacagtcatcacccagacctactgaattagaatctcgggagtgcagggggcagcaacaggggggctgtcttttctgagaaggggtctcactctgtcaccaggctggagtgccatggcatgatctcagctcactgcaacctccacctcctgagttcaagccattctcctgcctcagcctcctgagtagctgggactacaggtgtgcgccactacactcagctaatttttgtattttaagtagagacggggtttcatcatgttggccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccatcgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagagaataagttgaaatcaatgaccagaagaccctgatggaagtggaggagaatcatctcaggcaaactttttgtgtgccagtaacagaaaccctctttgtgtgatcacatgcaaagtataggatatttgcaatatagccatggggaggagtgcagggcccaagggtagattttagccaggcctcccaggaacagaactcggatccgaaaagcccagagaagctagagctgcccctccaacactctcggatccacatggtctgtgttctctagacccccctgcatgttagcggtgttctctctctgtggactgactgtccttctcagtgaacatgtccacccgacagctcctgagtttatatcatctcaaccctcacaacccacagaggctgtgtctcctagtcacagctttaaattactggaaaaataaatgactggccaaacttggagcaggtgtccatcccagccctgtgtagttagagcaggaatcaagatctcaacacaaatgtggctgccaagcactcagccccggggcgaggggtcaagttcttctcagagaaagaggaataagttggttctcagaagacatcacaagatacgtgtgtacccaacaatctctgatctctgctgatcttttgcttagacgttaacttgatgcatcattggaaaggtgtttctctcatctctgtcctaaggcttgataaagtcattaaaattgtgttcttttgactaaagaaaa

SEQ ID NO: 298556 - DNA, 2778 bp, Homo sapiens
acctggatggaactagtgccagcgaggctgtcatttttaaccggtctggatgactctgatgcagccatcctggaccttggctgtggtctggtaactggaacccagtgtccccaggtaatgatccttctgagagaaatgacttgtgggagacaccctgcagatcctcatgggtttgtgacagcccctgcgtgctcagtgccctttaagtgcatcccgctgtgctgactttgagtgggatcaacatctgtcctacgggtcccctcttttttggccccagtattcatggcagggtttgttggacacctactagcttcccttcccattcaacacacacacacattcttgctctacccaaagctctggctggcagcactaaatgctttggtggtgtttgcactgtgtcctttccaggccttggccagttcttccaggggtgaggcatgtggtgctggggattggcagccatcctggggcccacacaggtgtgtcttgctccatttggcccattgtgtgttactttgtgaatgagccatttcacatggacttcatgaaatttgcctcctgagttcaggtttaccctgaaagggatgcagattatcctgttcctcacgaccccctcagctaacaacagttctgaagggtgctgggacaggacaggctcatggggactccactcctgcctgggtttactctgtatgaagaggccactggtatcctgccatgatgttatctcctttttctactttccctagagtcccatgcatgataaagagaggcccaaggcttggataaggtggccacttccctcagtggagtcagtcatgttaggtaggaggtggtagagtcggtctgcaaggtatctcgtaagaggggaggtccacctagacacactctaaatatgtggcctagaagattttggtctacttttctgtgaacagaatttaaaacatacaaagagataaatcaccataccacatagtttatgtcaagaccaaaatgagcaatacagattacggttttcaaaccagaatgcacataagaactgcttgggatccttttaaaagtacaggcattggcctggtgcagtggctcattcctgtaatcccagcactttgggaggccaaggggacaggactgcttgaggccaagaggtggaaaccatcttgggctacatagagagaccccatctctacaaagaaagatttaaaaattaaccagccatggtggctcgcacctgtattcccagccactggggaggctgaggccggaggagtgcttgagcccaggagttcaaggctgcagtgagccaagattgcgccactgcactccagcctaggtgacagagtgagaccctgtctctaaataaataaataaataaaatataaaaataacagtcatcacccagacctactgaattagaatctcgggagtgcagggggcagcaacaggggggctgtcttttctgagaaggggtctcactctgtcaccaggctggagtgccatggcatgatctcagctcactgcaacctccacctcctgagttcaagccattctcctgcctcagcctcctgagtagctgggactacaggtgtgcgccactacactcagctaatttttgtattttaagtagagacggggtttcatcatgttggccaggatggcctccatctcttgacctcgtgatccacccaccttccctcccaaagtactggaattacaggcattagccactgtgcccagccgaggctgtcatttttaaccggctctggatgactctgatgcagccatcctggaccttggctgtggtctggtaactggaacccagtgacgtaatcaggtgccatcgggggtcatgggaaagggggatccccaaggtctgaggtggactaggaaggctttctgaagaacctgggtctgttagggcatcagccaatcaaggtacaagtaaatagaggcaaaatgagggtttgaactgtgagcagttggtcctggaaaagaaagaaaccaagagattatggggactcaatgggcttcttaagagagaataagttgaaatcaatgaccagaagaccctgatggaagtggaggagaatcatctcaggcaaactttttgtgtgccagtaacagaaaccctctttgtgtgatcacatgcaaagtataggatatttgcaatatagccatggggaggagtgcagggcccaagggtagattttagccaggcctcccaggaacagaactcggatccgaaaagcccagagaagctagagctgcccctccaacactctcggatccacatggtctgtgttctctagacccccctgcatgttagcggtgttctctctctgtggactgactgtccttctcagtgaacatgtccacccgacagctcctgagtttatatcatctcaaccctcacaacccacagaggctgtgtctcctagtcacagctttaaattactggaaaaataaatgactggccaaacttggagcaggtgtccatcccagccctgtgtagttagagcaggaatcaagatctcaacacaaatgtggctgccaagcactcagccccggggcgaggggtcaagttcttctcagagaaagaggaataagttggttctcagaagacatcacaagatacgtgtgtacccaacaatctctgatctctgctgatcttttgcttagacgttaacttgatgcatcattggaaaggtgtttctctcatctctgtcctaaggcttgataaagtcattaaaattgtgttcttttgactaaagaaaa

SEQ ID NO: 298557 - DNA, 823 bp, Homo sapiens
cttcttctttacctccgccttgttcctgtcctcaccacacggactgagactgatttgattaaagcaccagagtgtaatggccctcagagcagggctggtcctggggttccacaccctgatgaccctcctgagcccgcaggaggcaggggccaccaaggggccagcccagtgtcagaacaggactctgtccccacacagaacccaggacggggcccaggctcagggactcaacaatcacatattgtggatgagacagacacatttttttctctctccttgaccctgaactcgccaaacacagctgaccacatgggctcctacggacccgccttctaccagtcttacggcgcctcgggccagttcacccatgaatttgatgaggaacagctgttctctgtggacctgaagaaaagcgaggccgtgtggcgtctgcctgagtttggtgactttgcccgctttgacccgcagggcgggctggccggcatcgccgcaatcaaagcccatctggacatcctggtggagcgctccaaccgcagcagagccatcaacgccctgtgtagttagagcaggaatcaagatctcaacacaaatgtggctgccaagcactcagccccggggcgaggggtcaagttcttctcagagaaagaggaataagttggttctcagaagacatcacaagatacgtgtgtacccaacaatctctgatctctgctgatcttttgcttagacgttaacttgatgcatcattggaaaggtgtttctctcatctctgtcctaaggcttgataaagtcattaaaattgtgttcttttgactaaagaaaa

SEQ ID NO: 298558 - DNA, 684 bp, Homo sapiens
agaagcttaagctctttaagaaatgtggatttgtaaagagatgatccaaaagggagaaacaagcaaaggaggattttgagagcttcaggaggtggccacacagtgaggttagctttgtatcctaggggattcttaccaagaaaaaccttgtattgcaaggcctggaaacaatgtaatatgtaaccaaatggtaacagtaacagctgggaaagagagaaaggctggctttggcagatgaaccaggagaattgtgttcctttttatcccctggggacactaaattcccaaacgcatattatttagttatttttagatatgcagcctgcagggaaaccgctgagaacattcccgtgtaaatcctcattcagctttctgaagtcagcattgtctgatgagtacctgttacagaggagggtttggggtggctgcgctgtgttccttcataggaaccgttgacatgtgtttaggggtgtctgggcactgtgacctcgaggcagtgtccgctgagagtgccagaggatggatggcgccttgaagttactccgttttctctgccatccaatgaattgcttgtaaatttcctgccacattactattgcatttcccaaaaataagataaacatcctcaaaatgtcataagctatatttttaatttgaatgttggtctgtatttctgtcatatgc

SEQ ID NO: 298559 - DNA, 685 bp, Homo sapiens
aggcacatgtcaccatacctggctagttttttttttatttttgttgagacaaggtttcaccacgttgcccaaactggtcttaaattcttgagatcaagtgatccatgtcgacctcccaaagtgctgagattacaagcatgagccactgcacctgaccagtggctttttttaatgtttacctttgttctattgaatatacatctactacttgatatgtcagctgtaagtattatctttgactgccagctactgagacagtcaacaagcttgttctacttttctcccttttcctcctcattcctttcccagtttttgttggttatattgtttctacactgtcagaacatataacactttacaactcatatccgcagctttgttactggcttatatctccagttaagtatgttattaataattgtttatctctggtccttttaccaaaaatttccccatctcttggttggctggagcttgtcttctagtttattcagaaaggctcgtgaaaaatataccccatatttgtgcacattcaaaattggttgaataaagcatttggtttctacatgtaagagctaagattgtaaaattatatcgttttctcaaagtgcagcttaagttgcatctcacaaaattttaatatgttgtattttcattaacatttagttcaaaatgttatctagtt

SEQ ID NO: 298560 - DNA, 1086 bp, Homo sapiens
atggggtttcaccatgttagtcaagctgctcttgttttgttgttgttgttgttgtgttgtaagcgtccttatctttcagagctacatagtggaatgtttatggaatatttaggataaatgatataggcatttgggatttgctgcaaaatgacccagaggcaggggtcagggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagtatacatggcctggtcctaccagagactcacccaatgccagcctccagccagggagagccaagtttgcattttcacacgcatctcacactcctctgcactctcaacttggagagctccaaacagggaaaccccaagccttgctggcttctgccaaccccctgagcagaagcatgggtccccctgatcaccacctcaccaccctcatcctgatctcactgtacactccctttcctggtctgctaagtagcgggtgtttttccttgacactaacgctacagctagaccacggtgggcttggcaacaggtgtcttcccagatgctggcgttaccgctagaccaaggagccctctggtggccccgtccgggcataacagaaagctcgcactcttgtcttctggtcactcctcactgtccccttcagcctcctatctctgtatggcctggtgtttcctaggttatgattgtagagcgaggattattataatattggaataaagaataattactacaaactaatgattaatgattcatatataatcatatctaagatctatatctagtataactattcttattttatatattttattatactggaacagctcgtgccctcggtctcttgcctcggcacctgggtggcttgctgcccacatccaccaagtgcactttgggaggctgaggctggaggactgctggaggccaggagttcaataccagcctgggcaacatagggagaccccccccccaccatctcc

SEQ ID NO: 298561 - DNA, 954 bp, Homo sapiens
aattcgcggccgcgtcgacgaagacgacagaagggggggggagaggtagagatgagacaagaggtagaggggagaggtagaggtagccacgagctgataattacagacaagagatgcggagtatgtgggggctcattatcctgcatagtctatctttgtatatctttgaacttttcaagaataaaaaagcttaaaaagtatacatggcctggtcctaccagagactcacccaatgccagcctccagccagggagagccaagtttgcattttcacacgcatctcacactcctctgcactctcaacttggagagctccaaacagggaaaccccaagccttgctggcttctgccaaccccctgagcagaagcatgggtccccctgatcaccacctcaccaccctcatcctgatctcactgtacactccctttcctggtctgctaagtagcgggtgtttttccttgacactaacgctacagctagaccacggtgggcttggcaacaggtgtcttcccagatgctggcgttaccgctagaccaaggagccctctggtggccccgtccgggcataacagaaagctcgcactcttgtcttctggtcactcctcactgtccccttcagcctcctatctctgtatggcctggtgtttcctaggttatgattgtagagcgaggattattataatattggaataaagaataattactacaaactaatgattaatgattcatatataatcatatctaagatctatatctagtataactattcttattttatatattttattatactggaacagctcgtgccctcggtctcttgcctcggcacctgggtggcttgctgcccacatccaccaagtgcactttgggaggctgaggctggaggactgctggaggccaggagttcaataccagcctgggcaacatagggagaccccccccccaccatctcc

SEQ ID NO: 298562 - DNA, 2115 bp, Homo sapiens
ctttgcaactactggccagtgggaggttaccactgaaagggatggtaaaaaagaaactgcccagacggttggacaggacgtagacacacagaagaaaagaagacaaagaacgggtaggaaaattagggttaccatggggaagaaagtggccatcattggagctggtgtgagtggcttggcctccatcaggagctgtctggaagaggggctggagcccacctgctttgagaagagcaatgacattgggggcctgtggaaattttcagaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttaccactgaaagggatggtaaaaaagaatcggctgtctttgatgctgtaatggtttgttccggacatcatgtgtatcccaacctaccaaaagagtcctttccaggactaaaccactttaaaggcaaatgcttccacagcagggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtcactcgatttggaaccttcctcaagaacaatttaccgacagccatctctgactggttgtacgtgaagcagatgaatgcaagattcaagcatgaaaactatggcttgatgcctttaaatggagtcctgaggaaagagcctgtatttaacgatgagctcccagcaagcattctgtgtggcattgtgtccgtaaagcctaacgtgaaggaattcacagagacctcggccatttttgaggatgggaccatatttgagggcattgactgtgtaatctttgcaacagggtatagttttgcctaccccttccttgatgagtctatcatcaaaagcagaaacaatgagatcattttatttaaaggagtatttcctcctctacttgagaagtcaaccatagcagtgattggctttgtccagtcccttggggctgccattcccacagttgacctccagtcccgctgggcagcacaagtaataaagggaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctgaaagttactgacaatacccagacaggggctttgctatttaaaaattaaaattttcacaccacctgcttttctattcagcatcttttgcagtactctgtagacattagtcagtaatacagtgttatttctaggctctgaaatagccactttaagaatcatgtcatgatcttaagagagcactaatcatttctgtttgagttccactaacacttcaaaatcagaactatgttctttatatctaacttaaatcatttcctgaaacattttgacatgattcctttttccttttaaacaatgtatgaaagatgtattttaaatctaaataaagagcaaattaagcagaataattataatatgat

SEQ ID NO: 298563 - DNA, 850 bp, Homo sapiens
cagttatatataatgtattaagaaagaaaaagagaacccgagagaagctcagaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctgaaagttactgacaatacccagacaggggctttgctatttaaaaattaaaattttcacaccacctgcttttctattcagcatcttttgcagtactctgtagacattagtcagtaatacagtgttatttctaggctctgaaatagccactttaagaatcatgtcatgatcttaagagagcactaatcatttctgtttgagttccactaacacttcaaaatcagaactatgttctttatatctaacttaaatcatttcctgaaacattttgacatgattcctttttccttttaaacaatgtatgaaagatgtattttaaatctaaataaagagcaaattaagcagaataattataatatgat

SEQ ID NO: 298564 - DNA, 2025 bp, Homo sapiens
actagaacattttctctttcaaactgcccagacggttggacaggacgtagacacacagaagaaaagaagacaaagaacgggtaggaaaattagggttaccatggggaagaaagtggccatcattggagctggtgtgagtggcttggcctccatcaggagctgtctggaagaggggctggagcccacctgctttgagaagagcaatgacattgggggcctgtggaaattttcagaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagatcctgattttgcaactactggccagtgggatgttaccactgaaagggatggtaaaaaagaatcggctgtctttgatgctgtaatggtttgttccggacatcatgtgtatcccaacctaccaaaagagtcctttccaggactaaaccactttaaaggcaaatgcttccacagcagggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtcactcgatttggaaccttcctcaagaacaatttaccgacagccatctctgactggttgtacgtgaagcagatgaatgcaagattcaagcatgaaaactatggcttgatgcctttaaatggagtcctgaggaaagagcctgtatttaacgatgagctcccagcaagcattctgtgtggcattgtgtccgtaaagcctaacgtgaaggaattcacagagacctcggccatttttgaggatgggaccatatttgagggcattgactgtgtaatctttgcaacagggtatagttttgcctaccccttccttgatgagtctatcatcaaaagcagaaacaatgagatcattttatttaaaggagtatttcctcctctacttgagaagtcaaccatagcagtgattggctttgtccagtcccttggggctgccattcccacagttgacctccagtcccgctgggcagcacaagtaataaagggaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctgaaagttactgacaatacccagacaggggctttgctatttaaaaattaaaattttcacaccacctgcttttctattcagcatcttttgcagtactctgtagacattagtcagtaatacagtgttatttctaggctctgaaatagccactttaagaatcatgtcatgatcttaagagagcactaatcatttctgtttgagttccactaacacttcaaaatcagaactatgttctttatatctaacttaaatcatttcctgaaacattttgacatgattcctttttccttttaaacaatgtatgaaagatgtattttaaatctaaataaagagcaaattaagcagaataattataatatgat

SEQ ID NO: 298565 - DNA, 1971 bp, Homo sapiens
actagaacattttctctttcaaactgcccagacggttggacaggacgtagacacacagaagaaaagaagacaaagaacgggtaggaaaattagggttaccatggggaagaaagtggccatcattggagctggtgtgagtggcttggcctccatcaggagctgtctggaagaggggctggagcccacctgctttgagaagagcaatgacattgggggcctgtggaaattttcagaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagatcctgattttgcaactactggccagtgggatgttaccactgaaagggatggtaaaaaagaatcggctgtctttgatgctgtaatggtttgttccggacatcatgtgtatcccaacctaccaaaagagtcctttccaggactaaaccactttaaaggcaaatgcttccacagcagggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtcactcgatttggaaccttcctcaagaacaatttaccgacagccatctctgactggttgtacgtgaagcagatgaatgcaagattcaagcatgaaaactatggcttgatgcctttaaatggagtcctgaggaaagagcctgtatttaacgatgagctcccagcaagcattctgtgtggcattgtgtccgtaaagcctaacgtgaaggaattcacagagacctcggccatttttgaggatgggaccatatttgagggcattgactgtgtaatctttgcaacagggtatagttttgcctaccccttccttgatgagtctatcattgagaagtcaaccatagcagtgattggctttgtccagtcccttggggctgccattcccacagttgacctccagtcccgctgggcagcacaagtaataaagggaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctgaaagttactgacaatacccagacaggggctttgctatttaaaaattaaaattttcacaccacctgcttttctattcagcatcttttgcagtactctgtagacattagtcagtaatacagtgttatttctaggctctgaaatagccactttaagaatcatgtcatgatcttaagagagcactaatcatttctgtttgagttccactaacacttcaaaatcagaactatgttctttatatctaacttaaatcatttcctgaaacattttgacatgattcctttttccttttaaacaatgtatgaaagatgtattttaaatctaaataaagagcaaattaagcagaataattataatatgat

SEQ ID NO: 298566 - DNA, 2045 bp, Homo sapiens
actagaacattttctctttcaaactgcccagacggttggacaggacgtagacacacagaagaaaagaagacaaagaacgggtaggaaaattagggttaccatggggaagaaagtggccatcattggagctggtgtgagtggcttggcctccatcaggagctgtctggaagaggggctggagcccacctgctttgagaagagcaatgacattgggggcctgtggaaattttcagaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttaccactgaaagggatggtaaaaaagaatcggctgtctttgatgctgtaatggtttgttccggacatcatgtgtatcccaacctaccaaaagagtcctttccagggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtcactcgatttggaaccttcctcaagaacaatttaccgacagccatctctgactggttgtacgtgaagcagatgaatgcaagattcaagcatgaaaactatggcttgatgcctttaaatggagtcctgaggaaagagcctgtatttaacgatgagctcccagcaagcattctgtgtggcattgtgtccgtaaagcctaacgtgaaggaattcacagagacctcggccatttttgaggatgggaccatatttgagggcattgactgtgtaatctttgcaacagggtatagttttgcctaccccttccttgatgagtctatcatcaaaagcagaaacaatgagatcattttatttaaaggagtatttcctcctctacttgagaagtcaaccatagcagtgattggctttgtccagtcccttggggctgccattcccacagttgacctccagtcccgctgggcagcacaagtaataaagggaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctgaaagttactgacaatacccagacaggggctttgctatttaaaaattaaaattttcacaccacctgcttttctattcagcatcttttgcagtactctgtagacattagtcagtaatacagtgttatttctaggctctgaaatagccactttaagaatcatgtcatgatcttaagagagcactaatcatttctgtttgagttccactaacacttcaaaatcagaactatgttctttatatctaacttaaatcatttcctgaaacattttgacatgattcctttttccttttaaacaatgtatgaaagatgtattttaaatctaaataaagagcaaattaagcagaataattataatatgat

SEQ ID NO: 298567 - DNA, 2366 bp, Homo sapiens
agggattctcctgcctcagcctcccgaatagttgggattacagatgggatggatgtgaatccttgggaaccagaggatggcctgtaataggctgaacaatttaacaatgcccctcctcaaagatatcacatccaaattcctggaacctgtaaatgttatcttacttacaagagaaaagggtatttgcaaatataattaagttaaaaatcttaagatggagagatttttctgcattatgtgggtgagccccaaacgctataatgaatgcatcgttaaaagagagaggcagagggagatttaacacaaagagaagagagaaggtgatgtgatgacctcaacagaaagagagaaatttgaagatgctatgctctatctttgatgatggccagaggagccatgagtgaaggcgtacaagaggggtcttgccactgaaaaaaataagaaatgccagcatccaccagaagccagaagcggcaaggaatggattctctcctggagcctctgaaaatgaacatggaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttaccactgaaagggatggtaaaaaagaatcggctgtctttgatgctgtaatggtttgttccggacatcatgtgtatcccaacctaccaaaagagtcctttccaggactaaaccactttaaaggcaaatgcttccacagcagggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtcactcgatttggaaccttcctcaagaacaatttaccgacagccatctctgactggttgtacgtgaagcagatgaatgcaagattcaagcatgaaaactatggcttgatgcctttaaatggagtcctgaggaaagagcctgtatttaacgatgagctcccagcaagcattctgtgtggcattgtgtccgtaaagcctaacgtgaaggaattcacagagacctcggccatttttgaggatgggaccatatttgagggcattgactgtgtaatctttgcaacagggtatagttttgcctaccccttccttgatgagtctatcatcaaaagcagaaacaatgagatcattttatttaaaggagtatttcctcctctacttgagaagtcaaccatagcagtgattggctttgtccagtcccttggggctgccattcccacagttgacctccagtcccgctgggcagcacaagtaataaagggaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctgaaagttactgacaatacccagacaggggctttgctatttaaaaattaaaattttcacaccacctgcttttctattcagcatcttttgcagtactctgtagacattagtcagtaatacagtgttatttctaggctctgaaatagccactttaagaatcatgtcatgatcttaagagagcactaatcatttctgtttgagttccactaacacttcaaaatcagaactatgttctttatatctaacttaaatcatttcctgaaacattttgacatgattcctttttccttttaaacaatgtatgaaagatgtattttaaatctaaataaagagcaaattaagcagaataattataatatgat

SEQ ID NO: 298568 - DNA, 2029 bp, Homo sapiens
caggacgtagacacacagaagaaaagaagacaaagaacggggttaccatggggaagaaagtggccatcattggagctggtgtgagtggcttggcctccatcaggagctgtctggaagaggggctggagcccacctgctttgagaagagcaatgacattgggggcctgtggaaattttcagaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttaccactgaaagggatggtaaaaaagaatcggctgtctttgatgctgtaatggtttgttccggacatcatgtgtatcccaacctaccaaaagagtcctttccaggactaaaccactttaaaggcaaatgcttccacagcagggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtcactcgatttggaaccttcctcaagaacaatttaccgacagccatctctgactggttgtacgtgaagcagatgaatgcaagattcaagcatgaaaactatggcttgatgcctttaaatggagtcctgaggaaagagcctgtatttaacgatgagctcccagcaagcattctgtgtggcattgtgtccgtaaagcctaacgtgaaggaattcacagagacctcggccatttttgaggatgggaccatatttgagggcattgactgtgtaatctttgcaacagggtatagttttgcctaccccttccttgatgagtctatcatcaaaagcagaaacaatgagatcattttatttaaaggagtatttcctcctctacttgagaagtcaaccatagcagtgattggctttgtccagtcccttggggctgccattcccacagttgacctccagtcccgctgggcagcacaagtaataaagggaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctgaaagttactgacaatacccagacaggggctttgctatttaaaaattaaaattttcacaccacctgcttttctattcagcatcttttgcagtactctgtagacattagtcagtaatacagtgttatttctaggctctgaaatagccactttaagaatcatgtcatgatcttaagagagcactaatcatttctgtttgagttccactaacacttcaaaatcagaactatgttctttatatctaacttaaatcatttcctgaaacattttgacatgattcctttttccttttaaacaatgtatgaaagatgtattttaaatctaaataaagagcaaattaagcagaataattataatatgat

SEQ ID NO: 298569 - DNA, 2242 bp, Homo sapiens
ctttgcaactactggccagtgggaggttaccactgaaagggatggtaaaaaagaaactgcccagacggttggacaggacgtagacacacagaagaaaagaagacaaagaacgggtaggaaaattagggttaccatggggaagaaagtggccatcattggagctggtgtgagtggcttggcctccatcaggagctgtctggaagaggggctggagcccacctgctttgagaagagcaatgacattgggggcctgtggaaattttcaaggagccatgagtgaaggcgtacaagaggggtcttgccactgaaaaaaataagaaatgccagcatccaccagaagccagaagcggcaaggaatggattctctcctggagcctctgaaaatgaacatggaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttaccactgaaagggatggtaaaaaagaatcggctgtctttgatgctgtaatggtttgttccggacatcatgtgtatcccaacctaccaaaagagtcctttccaggactaaaccactttaaaggcaaatgcttccacagcagggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtcactcgatttggaaccttcctcaagaacaatttaccgacagccatctctgactggttgtacgtgaagcagatgaatgcaagattcaagcatgaaaactatggcttgatgcctttaaatggagtcctgaggaaagagcctgtatttaacgatgagctcccagcaagcattctgtgtggcattgtgtccgtaaagcctaacgtgaaggaattcacagagacctcggccatttttgaggatgggaccatatttgagggcattgactgtgtaatctttgcaacagggtatagttttgcctaccccttccttgatgagtctatcatcaaaagcagaaacaatgagatcattttatttaaaggagtatttcctcctctacttgagaagtcaaccatagcagtgattggctttgtccagtcccttggggctgccattcccacagttgacctccagtcccgctgggcagcacaagtaataaagggaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctgaaagttactgacaatacccagacaggggctttgctatttaaaaattaaaattttcacaccacctgcttttctattcagcatcttttgcagtactctgtagacattagtcagtaatacagtgttatttctaggctctgaaatagccactttaagaatcatgtcatgatcttaagagagcactaatcatttctgtttgagttccactaacacttcaaaatcagaactatgttctttatatctaacttaaatcatttcctgaaacattttgacatgattcctttttccttttaaacaatgtatgaaagatgtattttaaatctaaataaagagcaaattaagcagaataattataatatgat

SEQ ID NO: 298570 - DNA, 1926 bp, Homo sapiens
ctttgcaactactggccagtgggaggttaccactgaaagggatggtaaaaaagaaactgcccagacggttggacaggacgtagacacacagaagaaaagaagacaaagaacgggtaggaaaattagggttaccatggggaagaaagtggccatcattggagctggtgtgagtggcttggcctccatcaggagctgtctggaagaggggctggagcccacctgctttgagaagagcaatgacattgggggcctgtggaaattttcaacatttgtatccagtgtaaataaacatcctgattttgcaactactggccagtgggatgttaccactgaaagggatggtaaaaaagaatcggctgtctttgatgctgtaatggtttgttccggacatcatgtgtatcccaacctaccaaaagagtcctttccaggactaaaccactttaaaggcaaatgcttccacagcagggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtcactcgatttggaaccttcctcaagaacaatttaccgacagccatctctgactggttgtacgtgaagcagatgaatgcaagattcaagcatgaaaactatggcttgatgcctttaaatggagtcctgaggaaagagcctgtatttaacgatgagctcccagcaagcattctgtgtggcattgtgtccgtaaagcctaacgtgaaggaattcacagagacctcggccatttttgaggatgggaccatatttgagggcattgactgtgtaatctttgcaacagggtatagttttgcctaccccttccttgatgagtctatcatcaaaagcagaaacaatgagatcattttatttaaaggagtatttcctcctctacttgagaagtcaaccatagcagtgattggctttgtccagtcccttggggctgccattcccacagttgacctccagtcccgctgggcagcacaagtaataaagggaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctgaaagttactgacaatacccagacaggggctttgctatttaaaaattaaaattttcacaccacctgcttttctattcagcatcttttgcagtactctgtagacattagtcagtaatacagtgttatttctaggctctgaaatagccactttaagaatcatgtcatgatcttaagagagcactaatcatttctgtttgagttccactaacacttcaaaatcagaactatgttctttatatctaacttaaatcatttcctgaaacattttgacatgattcctttttccttttaaacaatgtatgaaagatgtattttaaatctaaataaagagcaaattaagcagaataattataatatgat

SEQ ID NO: 298571 - DNA, 1094 bp, Homo sapiens
cgtcgtgctagaggatcccgcaatgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtcactcgatttggaaccttcctcaagaacaatttaccgacagccatctctgactggttgtacgtgaagcagatgaatgcaagattcaagcatgaaaactatggcttgatgcctttaaatgggaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctgaaagttactgacaatacccagacaggggctttgctatttaaaaattaaaattttcacaccacctgcttttctattcagcatcttttgcagtactctgtagacattagtcagtaatacagtgttatttctaggctctgaaatagccactttaagaatcatgtcatgatcttaagagagcactaatcatttctgtttgagttccactaacacttcaaaatcagaactatgttctttatatctaacttaaatcatttcctgaaacattttgacatgattcctttttccttttaaacaatgtatgaaagatgtattttaaatctaaataaagagcaaattaagcagaataattataatatgat

SEQ ID NO: 298572 - DNA, 1971 bp, Homo sapiens
actagaacattttctctttcaaactgcccagacggttggacaggacgtagacacacagaagaaaagaagacaaagaacgggtaggaaaattagggttaccatggggaagaaagtggccatcattggagctggtgtgagtggcttggcctccatcaggagctgtctggaagaggggctggagcccacctgctttgagaagagcaatgacattgggggcctgtggaaattttcagaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagatcctgattttgcaactactggccagtgggatgttaccactgaaagggatggtaaaaaagaatcggctgtctttgatgctgtaatggtttgttccggacatcatgtgtatcccaacctaccaaaagagtcctttccaggactaaaccactttaaaggcaaatgcttccacagcagggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtcactcgatttggaaccttcctcaagaacaatttaccgacagccatctctgactggttgtacgtgaagcagatgaatgcaagattcaagcatgaaaactatggcttgatgcctttaaatggagtcctgaggaaagagcctgtatttaacgatgagctcccagcaagcattctgtgtggcattgtgtccgtaaagcctaacgtgaaggaattcacagagacctcggccatttttgaggatgggaccatatttgagggcattgactgtgtaatctttgcaacagggtatagttttgcctaccccttccttgatgagtctatcatcaaaagcagaaacaatgagatcattttatttaaaggagtatttcctcctctacttgagaagtcaaccatagcagtgattggctttgtccagtcccttggggctgccattcccacagttgacctccagtcccgctgggcagcacaagtaataaagggaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctgaaagttactgacaatacccagacaggggctttgctatttaaaaattacattagtcagtaatacagtgttatttctaggctctgaaatagccactttaagaatcatgtcatgatcttaagagagcactaatcatttctgtttgagttccactaacacttcaaaatcagaactatgttctttatatctaacttaaatcatttcctgaaacattttgacatgattcctttttccttttaaacaatgtatgaaagatgtattttaaatctaaataaagagcaaattaagcagaataattataatatgat

SEQ ID NO: 298573 - DNA, 866 bp, Homo sapiens
atttggtgtctgtctgaaaatgaacaccaattaatgtaattcataactcattattaaaaagggaaaattacaggctggtcctatgccagactcattaattaccatcgtgtctttccttctttatcaggaacttgtactttgccttctatggaagacatgatgaatgatattaatgagaaaatggagaaaaagcgcaaatgcttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctgaaagttactgacaatacccagacaggggctttgctatttaaaaattaaaattttcacaccacctgcttttctattcagcatcttttgcagtactctgtagacattagtcagtaatacagtgttatttctaggctctgaaatagccactttaagaatcatgtcatgatcttaagagagcactaatcatttctgtttgagttccactaacacttcaaaatcagaactatgttctttatatctaacttaaatcatttcctgaaacattttgacatgattcctttttccttttaaacaatgtatgaaagatgtattttaaatctaaataaagagcaaattaagcagaataattataatatgat

SEQ ID NO: 298574 - DNA, 329 bp, Homo sapiens
ttcctccatgggcacaacaggcgggacagatccacaggcagcaagagcactggacaaggtctcaggtgtggtgagcactgaggcaggagaccagggtcagggggaggtgtccacaatgctgatctggctaaaagtcccttctctgcttaaagctcaacaaaagcaaataacagtgttgaaggaaaatgtacgccagataagataaagctcatacccaactaaaaggttaagacccctgtagataaatgggcaaagaacctgaaaacactgcatactgcaggaaggagggaatgcggtggcctaacaaatatttgggggaaggttcaact

SEQ ID NO: 298575 - DNA, 2452 bp, Homo sapiens
agaaagcgagcagccacccagctccccgccaccgccatggtccccgacaccgcctgcgttcttctgctcaccctggctgccctcggcgcgtccggacagggccagagcccgttgggctcagacctgggcccgcagatgcttcgggaactgcaggaaaccaacgcggcgctgcaggacgtgcgggagctgctgcggcagcaggtcagggagatcacgttcctgaaaaacacggtgatggagtgtgacgcgtgcgggatgcagcagtcagtacgcaccggcctacccagcgtgcggcccctgctccactgcgcgcccggcttctgcttccccggcgtggcctgcatccagacggagagcggcgcgcgctgcggcccctgccccgcgggcttcacgggcaacggctcgcactgcaccgacgtcaacgagtgcaacgcccacccctgcttcccccgagtccgctgtatcaacaccagcccggggttccgctgcgaggcttgcccgccggggtacagcggccccacccaccagggcgtggggctggctttcgccaaggccaacaagcaggtttgcacggacatcaacgagtgtgagaccgggcaacataactgcgtccccaactccgtgtgcatcaacacccggggctccttccagtgcggcccgtgccagcccggcttcgtgggcgaccaggcgtccggctgccagcggcgcgcacagcgcttctgccccgacggctcgcccagcgagtgccacgagcatgcagactgcgtcctagagcgcgatggctcgcggtcgtgcgtgtgtgccgttggctgggccggcaacgggatcctctgtggtcgcgacactgacctagacggcttcccggacgagaagctgcgctgcccggagcgccagtgccgtaaggacaactgcgtgactgtgcccaactcagggcaggaggatgtggaccgcgatggcatcggagacgcctgcgatccggatgccgacggggacggggtccccaatgaaaaggacaactgcccgctggtgcggaacccagaccagcgcaacacggacgaggacaagtggggcgatgcgtgcgacaactgccggtcccagaagaacgacgaccaaaaggacacagaccaggacggccggggcgatgcgtgcgacgacgacatcgacggcgaccggatccgcaaccaggccgacaactgccctagggtacccaactcagaccagaaggacagtgatggcgatggtataggggatgcctgtgacaactgtccccagaagagcaacccggatcaggcggatgtggaccacgactttgtgggagatgcttgtgacagcgatcaagaccaggatggagacggacatcaggactctcgggacaactgtcccacggtgcctaacagtgcccaggaggactcagaccacgatggccagggtgatgcctgcgacgacgacgacgacaatgacggagtccctgacagtcgggacaactgccgcctggtgcctaaccccggccaggaggacgcggacagggacggcgtgggcgacgtgtgccaggacgactttgatgcagacaaggtggtagacaagatcgacgtgtgtccggagaacgctgaagtcacgctcaccgacttcagggccttccagacagtcgtgctggacccggagggtgacgcgcagattgaccccaactgggtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgacagcaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggaccagggtgaggacccgccggatgacagccaccctcaccgcggctggatgggggctctgcacccagccccaaggggtggccgtcctgagggggaagtgagaagggctcagagaggacaaaataaagtgtgtgtgcaggga

SEQ ID NO: 298576 - DNA, 865 bp, Homo sapiens
agaaagcgagcagccacccagctccccgccaccgccatggtccccgacaccgcctgcgttcttctgctcaccctggctgccctcggcgcgtccggacagggccagagcccgttgggtaagccgcgttagcacccgcgccgtgcccacggccccacaacggactgtaggacccgtgagaggcccgggatccaggctgtttggggctcacggactgttcgtaggggacgtgccgggcgcagaaagcaggtggcgggaccgagactagaggagcgcagtggggcctcggaggtccgggttcgctgcaacggtgggagttggtggtgggattccccggccccatgacgcctcaccaggtcccctgccgccgcaggctcagacctgggcccgcagatgcttcgggaactgcaggaaaccaacgcggcgctgcaggacgtgcgggagctgctgcggcagcaggtcaagggagatcacggttcctgaacaaacacggtgatggcgagtggtgaacagcgtgaggaacttgcacgcagaacagataagcacaccgggcattacaccagaagttgacggccctgtttccaagtgcgccggccccaggagcatacgagcattccaccaggaaagaatggacaccatgcagatcccacgaaagcgacagaggacagagacagctgccagaaatgaagagcaccaccatggacaccagacagggagcaaataaaaccaggagcaaaccaggaggatccgaaaccgtgcgaaccagaaccggtacaaaaggaacgttggaaaacaggacaaaaagcacagtgagatacgcaccgcgagaaatcacgaatggcactccaaacaacccagaaaccacggg

SEQ ID NO: 298577 - DNA, 386 bp, Homo sapiens
gaacgggtgactgtcgtgggggcggggaacaggtaactgtcacaggccaggggtaggtgacagtggtcaagggtgtcaattctggagccggtctgccaagcctcagggccagcctctgcttctttctagttatgagaccttggccatttgcttaacccttactgacgtaacacaccctattttactgtaataattatatgtttatttcaatgtgccatagagagacgtaatcagcacatcaattcccatcattgatattattgttaggacaaagctaacctgggtatttaagggatttttaagtaagtctgtttaaagaaaagtactaagtaaataatagtgcaggttccagttgggaagctgattcataagtgatgaaagttaag

SEQ ID NO: 298578 - DNA, 7884 bp, Homo sapiens
tgtgcgtcgcgctctcgccctcctcttcccgctgcagtgtctatggagcgaggctacgtttcattgccgccctggcttaacccttccggcgcctaaaaggacggccggccggccggtcccttgcaccaggaagaagtcttagcagccagcgggccctggtcaggaaactctaaggtacaaggaaaacagttgaggaaggagccagagcgctccggtttggtcctcgggcttcgctggggcggggcgcaggcgttggctttaagaaaggggaggggacagtgcaatccgggttgcccgcggattcggccaaggaatcttccgctcgctccggagcgaggagcctgtaaagaggctgttcccagctccagctctaacctcgcctacaccttgggcgggcccaatgtcacgtttgcaattgctcaggaaggatccggcccgtctccggaggcaagtcgggctgcggtttttgctgcttatctgggaaggcgatgcctaagggacatgctgcttgctaggcagcaccctgccgggatccgactgcgatagttagctctccctggccctgaagccatcgccggggcgcctgttctctgtccggaccagccagcgctcctcaggagtctcactgaaacagaaccatgggtcatcccccgctggagttcagcgactgctacctggacagccccgatttccgcgagaggctcaagtgttatgagcaggaactggagaggaccaacaaattcatcaaagacgtaatcaaagacggcaacgcgcttatcagcgctatgagaaattattcttctgctgttcagaaattttcccagacgctgcagtcatttcagtttgatttcattggagacactctgactgatgatgaaattaacatcgctgaatccttcaaggaatttgctgaattgctcaacgaggtagaaaatgagaggatgatgatggtacacaatgctagtgatttgctgattaaacccttggaaaatttccggaaggaacaaataggcttcaccaaggagcggaaaaagaaatttgaaaaggatggtgagaggttttattctttactggatcggcacttacacctgtcttcaaaaaagaaagaatctcagttacaagaggcagacctacaggtggacaaggagaggcacaattttttcgagtcctctcttgattatgtttatcaaatccaggaagttcaggagtccaagaagttcaatattgtggagcctgtcttggcctttcttcatagtctgttcatttctaacagcctgactgtggagctcacacaggatttcctcccatacaaacaacagctccaactcagtttacagaatacaagaaatcatttctccagtacccgggaagagatggaagaacttaagaaaaggatgaaagaagctccccagacatgcaaacttccaggacagccaactattgaaggctatctctatacacaagagaaatgggctttaggaatatcctgggtgaaatactattgccagtatgagaaagagaccaaaacactgaccatgacgcctatggagcagaagccaggtgctaagcaggggcccttggacttaacactgaagtactgtgtgagaaggaagacggagtctatcgacaagaggttctgttttgacatagaaactaatgaaaggccaggaaccatcactctgcaggccctttcagaagctaacagaaggctatggatggaagccatggatgggaaagaacctatctaccacagccctataacaaaacagcaagaaatggagctaaatgaagtgggcttcaagtttgtcaggaagtgcatcaatattattgagaccaaagggatcaagacagaagggttgtaccgcactgtgggcagcaatattcaggttcagaagctgctgaatgccttttttgatcctaaatgcccaggagatgttgattttcataatagtgactgggacattaagacaatcaccagctccttgaaattctacctcaggaatctttctgaacctgtcatgacctatagacttcacaaagagctggtctctgctgccaagtctgacaacctggattaccgcctaggagctattcactccctggtatataagctaccagaaaagaaccgagagatgctggaacttctgataagacacttggtcaatgtgtgtgagcacagcaaagagaatcttatgaccccctccaacatgggagtaatctttgggcccaccctgatgagagctcaggaggacactgtggccgccatgatgaacatcaaattccagaacatagtggtggaaatactaatcgagcactttggcaagatctatttaggtccacctgaggaaagcgctgcaccgccagtgcctccgcctcgggtgacagcaagaaggcacaaaccaatcacgatttcaaagcgcttgctgcgagaaaggacggttttctatacttcttccctggatgaaagcgaagatgaaatccaacatcaaacaccgaatggtactatcaccagcagcatagaaccccccaagccaccacaacaccccaaactacctattcagaggagtggggaaactgatcctgggaggaagtccccaagcaggcctattttggatggcaagttggagccctgcccagaggtggacgtggggaagttggtgtctaggctgcaggatggagggaccaagatcaccccaaaggccaccaatggacccatgccaggctctgggcccaccaagaccccctctttccacataaagagaccagctccccggcccctggcccaccacaaggagggggatgctgacagtttcagcaaagtgcggcctccaggagaaaagccaaccatcatccgccccccagtgaggcccccagatcctccctgccgggcagctactccccaaaagccagaaccaaagccagatattgtggctggcaatgcgggggaaatcacatcatctgtggtggcttccaggaccaggttttttgaaacagcttcccggaaaacaggaagttctcaaggcagacttcctggagatgaaagttgaggctacaggttttaaaagccttggcctcagaggaccctttccaggttctgaaagagtctttcttcttcaaacctttgtgtgcggagtcattttgtgttgaagagcagctccttcctagccttgcactttcagactctctctgggaggccataaaataaggagcatatgtcctagacaggtgtttatatctcctttgtattctgtcttcatcccctcagaaggtctgttttgagttcctataacactgtgaagagctggactccctcaagccagactctgccaaaaccaagatatccacttacctgagttgaagaggggagctcagttttcaactcttccctgaacttcctgcttcctcagagggccattgaactctgagagatttggggctaaagactgatctcaggggtcttaccttgaactgaaggccacttgagttggggccattgcttaccttggttggaagggaatagaaatgtttgctgaacattggagaatctcaacatgtctcctactgaggatatggacactggtgccatgtcagcgctctggtgctgcagtatgttgccaagagcccgtctgctcctgcgaggctatgagtgggatgagtgatgcccccacagcacctccatgtggacttaggaaggtggccttcctgctgttacatgcagccacttaggacaaatctgcaaagcatgttttgcatgtaaaagcctaggtctatttggattattctttctccttttttttgacagcttcctgtcaagcaatcaagaaacaaacaaaagctgaacacatttctttttaaaaaaaggagactgtgtttggtcctgtaggagttctattttggggtcaaatgctagaaaaattgttaaggtggattgaggccaggcagctgtcactgctgcttcatgtttgccttctgcacataaactcttttatctcctgaaaaaagcagttcttaacccagtgtccatggactcagaaactccatgatgcccctgagatggtatgcacaattccatgacaatatgccctttctggggagatagtccataatgttctgctaaatttcaaatgggctcgtgacccaaaaaagtcaagaaccacagcacttgagttaaaatactctttttacaatccatataagcccttgattggaagggcttttcaaaatcatttagtctaacaactgcccagtttccagtcgggggaactgaggcagagcaaggtagtgatcacaccagtacaagatttcaggtcccaggctcctatgcaagttttttttccccattatatcacacttatttagcaagggaccttgtggtttgtggctttagtggccatcatttctgggggttggcttttaccctttttcttgaatatttgccaccaagtgaaaaatgttaggacataaacccttgccaggtccctttcatttgctatctctattattggaaaggacctaaaaattggtgtaatggggcagaaatctgaggaatggacatttctaattcctgtttgttgaagggaagttgctggaaagagcatcagtacttgtttctatgcagatgcctgggccgtagcttgtctgtagcgtctgtataattataatgttgcccagtgtgagggaaagagctttcctacttgcactcttctaccaaggccctgttagtgcactgattatagtactgacagataaagcctagatgagagagatagagagtgagtacatgcacactcatgtgcaaacccactcagagatgcatttggaacagtgctactgaaaggcagtagtcattttcaagactgaattccaaacatggtttattggtgagttaggaacatgtaaggccaagtacactgagagcctttttgaaagtaattgagtggaaacttgatgccattctaaatcaaggcatatccaggtggcccggttgaactcactccactgtacccagtctcaaaggccaggttgctaagaaaccaggagtaaaagagtcaagtgaccatcatttcacctgctgcttgcccccaatagtagtctctgtgaggccttactgacctcacctaggaagtgatttttgagcccttgtttcagggctgtggcctccctgctctatcctgaataaagcagacaggtgtgcagattttggccatgaaagcatggctaatagggccacagtccctttaaagaaacatggtttgactctggttttcttgggggaaaataccacaatcaccgatgcaaacattggaagattattgagagccctagaaagctgctgtgatcccagtagaaaatatgtcccagaaatgtcatgagattgctgtgtgttgcctgggacacagatcaagggcctatcttggagagctggggaccagcagtctgcctggaggccagggagcagtggctgagtagctctgcctttgctctggtctataccttaagaatgccaaagaatgaatttcaacgcctgcctttggcactctgacttaaagtgcaaaaagcttctgtggcgaggcatgctatcatggaatgagactggcttgccctaggcttaatggatgggcagtcattttgcagaggctatgggaagagggtgataatagaagagtggcagctataggaaattatcaacataccttggccagcaagttagagaatctggcaatggatgaactgaaagtgatgaactggcagggataacaaagaacctaacatttattaagcacgtatttattaactgctcagtgtttcatattcatgcaagtattctcattttacagagaaagaaattatggcccagggggctaaagtaaacaactcaagggcacatagaaagtaaataaaaggactgtgatttgaatccaggccactcttagcccatgctgttttccctttgccacactgtggtaggtgtttgaacagaggccacattactagagttggcatgactcttgactcttgcctgcctaacaaaatattgaaaggcaaacatttgaaggagggagggggtgcaggttcagtttatatggaaatgcaaactgggctggaagatattcctgagttaggctttctcttcatattcagcttgcacatttggtaatgtttttaagatgatcatctaattttattttgtgaagtgaaggatttgtgttttagttggcagttgttaagtccttggcttgccatttttcaaaaagtaaaaaggtcctcacaggtgtctccatacttcgccaaggttgtagcatgggcagtttcagtttcagcctaagagactggtgacatccacaaatgcagttttagaagcagaaaaggtcttggtgcctctgcagtacttgatgtattggggtcaaatctctacaaatttttctgtggtgatagcaaaatcaagagatggcttacaaaaagaaatattgaatttttatttttgaagtttttgttttttaaaaggttgggggtgttcagccactgagggacaaaacttagcatctaatttcaattatagtgtcatgcagagtatttctaaagtaattggttatcatgggaaagtattctcttttcaagaagttctttgattctgtaataactagaacaaataaagtagtaaaagaagaaatagttctgtgactaggaaaaaattgcttttgagagaacatagatcaattatactacttctaaggtagctgcagataagtggccttgacacattacaagcctggaaaaaaacatcagaaataataaaaaatttcagagagaatcaagatacctttttttttcttttttttttcttttttttattatactctaagttttagggtacatgtgcacattgtgcaggttagttacatatgtatacatgtgccatgctggtgcgctgcacccactaatgtgtcatctagcattaggtatatctcccagtgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtccaaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcgaaggacaagataccttaaagataagttttcgataaagaaaagccttcattttcctgggggaaatgaagcacttgatgccaaggacattagtagagggctagaaagattgcctgtgtgaaagacatatgctatatccaaataataaaacaaacgagatcctggggctcattcatgtgactttcaataaagtatgtagactgtctaatataagtggcc

SEQ ID NO: 298579 - DNA, 5869 bp, Homo sapiens
aaggaaggtggatgggaataggtttccagctggaagtttatctagtctgacaacctggattaccgcctaggagctattcactccctggtatataagctaccagaaaagaaccgagagatgctggaacttctgataagacacttggtcaatgtgtgtgagcacagcaaagagaatcttatgaccccctccaacatgggagtaatctttgggcccaccctgatgagagctcaggaggacactgtggccgccatgatgaacatcaaattccagaacatagtggtggaaatactaatcgagcactttggcaagatctatttaggtccacctgaggaaagcgctgcaccgccagtgcctccgcctcgggtgacagcaagaaggcacaaaccaatcacgatttcaaagcgcttgctgcgagaaaggacggttttctatacttcttccctggatgaaagcgaagatgaaatccaacatcaaacaccgaatggtactatcaccagcagcatagaaccccccaagccaccacaacaccccaaactacctattcagaggagtggggaaactgatcctgggaggaagtccccaagcaggcctattttggatggcaagttggagccctgcccagaggtggacgtggggaagttggtgtctaggctgcaggatggagggaccaagatcaccccaaaggccaccaatggacccatgccaggctctgggcccaccaagaccccctctttccacataaagagaccagctccccggcccctggcccaccacaaggagggggatgctgacagtttcagcaaagtgcggcctccaggagaaaagccaaccatcatccgccccccagtgaggcccccagatcctccctgccgggcagctactccccaaaagccagaaccaaagccagatattgtggctggcaatgcgggggaaatcacatcatctgtggtggcttccaggaccaggttttttgaaacagcttcccggaaaacaggaagttctcaaggcagacttcctggagatgaaagttgaggctacaggttttaaaagccttggcctcagaggaccctttccaggttctgaaagagtctttcttcttcaaacctttgtgtgcggagtcattttgtgttgaagagcagctccttcctagccttgcactttcagactctctctgggaggccataaaataaggagcatatgtcctagacaggtgtttatatctcctttgtattctgtcttcatcccctcagaaggtctgttttgagttcctataacactgtgaagagctggactccctcaagccagactctgccaaaaccaagatatccacttacctgagttgaagaggggagctcagttttcaactcttccctgaacttcctgcttcctcagagggccattgaactctgagagatttggggctaaagactgatctcaggggtcttaccttgaactgaaggccacttgagttggggccattgcttaccttggttggaagggaatagaaatgtttgctgaacattggagaatctcaacatgtctcctactgaggatatggacactggtgccatgtcagcgctctggtgctgcagtatgttgccaagagcccgtctgctcctgcgaggctatgagtgggatgagtgatgcccccacagcacctccatgtggacttaggaaggtggccttcctgctgttacatgcagccacttaggacaaatctgcaaagcatgttttgcatgtaaaagcctaggtctatttggattattctttctccttttttttgacagcttcctgtcaagcaatcaagaaacaaacaaaagctgaacacatttctttttaaaaaaaggagactgtgtttggtcctgtaggagttctattttggggtcaaatgctagaaaaattgttaaggtggattgaggccaggcagctgtcactgctgcttcatgtttgccttctgcacataaactcttttatctcctgaaaaaagcagttcttaacccagtgtccatggactcagaaactccatgatgcccctgagatggtatgcacaattccatgacaatatgccctttctggggagatagtccataatgttctgctaaatttcaaatgggctcgtgacccaaaaaagtcaagaaccacagcacttgagttaaaatactctttttacaatccatataagcccttgattggaagggcttttcaaaatcatttagtctaacaactgcccagtttccagtcgggggaactgaggcagagcaaggtagtgatcacaccagtacaagatttcaggtcccaggctcctatgcaagttttttttccccattatatcacacttatttagcaagggaccttgtggtttgtggctttagtggccatcatttctgggggttggcttttaccctttttcttgaatatttgccaccaagtgaaaaatgttaggacataaacccttgccaggtccctttcatttgctatctctattattggaaaggacctaaaaattggtgtaatggggcagaaatctgaggaatggacatttctaattcctgtttgttgaagggaagttgctggaaagagcatcagtacttgtttctatgcagatgcctgggccgtagcttgtctgtagcgtctgtataattataatgttgcccagtgtgagggaaagagctttcctacttgcactcttctaccaaggccctgttagtgcactgattatagtactgacagataaagcctagatgagagagatagagagtgagtacatgcacactcatgtgcaaacccactcagagatgcatttggaacagtgctactgaaaggcagtagtcattttcaagactgaattccaaacatggtttattggtgagttaggaacatgtaaggccaagtacactgagagcctttttgaaagtaattgagtggaaacttgatgccattctaaatcaaggcatatccaggtggcccggttgaactcactccactgtacccagtctcaaaggccaggttgctaagaaaccaggagtaaaagagtcaagtgaccatcatttcacctgctgcttgcccccaatagtagtctctgtgaggccttactgacctcacctaggaagtgatttttgagcccttgtttcagggctgtggcctccctgctctatcctgaataaagcagacaggtgtgcagattttggccatgaaagcatggctaatagggccacagtccctttaaagaaacatggtttgactctggttttcttgggggaaaataccacaatcaccgatgcaaacattggaagattattgagagccctagaaagctgctgtgatcccagtagaaaatatgtcccagaaatgtcatgagattgctgtgtgttgcctgggacacagatcaagggcctatcttggagagctggggaccagcagtctgcctggaggccagggagcagtggctgagtagctctgcctttgctctggtctataccttaagaatgccaaagaatgaatttcaacgcctgcctttggcactctgacttaaagtgcaaaaagcttctgtggcgaggcatgctatcatggaatgagactggcttgccctaggcttaatggatgggcagtcattttgcagaggctatgggaagagggtgataatagaagagtggcagctataggaaattatcaacataccttggccagcaagttagagaatctggcaatggatgaactgaaagtgatgaactggcagggataacaaagaacctaacatttattaagcacgtatttattaactgctcagtgtttcatattcatgcaagtattctcattttacagagaaagaaattatggcccagggggctaaagtaaacaactcaagggcacatagaaagtaaataaaaggactgtgatttgaatccaggccactcttagcccatgctgttttccctttgccacactgtggtaggtgtttgaacagaggccacattactagagttggcatgactcttgactcttgcctgcctaacaaaatattgaaaggcaaacatttgaaggagggagggggtgcaggttcagtttatatggaaatgcaaactgggctggaagatattcctgagttaggctttctcttcatattcagcttgcacatttggtaatgtttttaagatgatcatctaattttattttgtgaagtgaaggatttgtgttttagttggcagttgttaagtccttggcttgccatttttcaaaaagtaaaaaggtcctcacaggtgtctccatacttcgccaaggttgtagcatgggcagtttcagtttcagcctaagagactggtgacatccacaaatgcagttttagaagcagaaaaggtcttggtgcctctgcagtacttgatgtattggggtcaaatctctacaaatttttctgtggtgatagcaaaatcaagagatggcttacaaaaagaaatattgaatttttatttttgaagtttttgttttttaaaaggttgggggtgttcagccactgagggacaaaacttagcatctaatttcaattatagtgtcatgcagagtatttctaaagtaattggttatcatgggaaagtattctcttttcaagaagttctttgattctgtaataactagaacaaataaagtagtaaaagaagaaatagttctgtgactaggaaaaaattgcttttgagagaacatagatcaattatactacttctaaggtagctgcagataagtggccttgacacattacaagcctggaaaaaaacatcagaaataataaaaaatttcagagagaatcaagatacctttttttttcttttttttttcttttttttattatactctaagttttagggtacatgtgcacattgtgcaggttagttacatatgtatacatgtgccatgctggtgcgctgcacccactaatgtgtcatctagcattaggtatatctcccagtgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtccaaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcgaaggacaagataccttaaagataagttttcgataaagaaaagccttcattttcctgggggaaatgaagcacttgatgccaaggacattagtagagggctagaaagattgcctgtgtgaaagacatatgctatatccaaataataaaacaaacgagatcctggggctcattcatgtgactttcaataaagtatgtagactgtctaatataagtggcc

SEQ ID NO: 298580 - DNA, 5815 bp, Homo sapiens
aaggaaggtggatgggaataggtttccagctggaagtttatctagtctgacaacctggattaccgcctaggagctattcactccctggtatataagctaccagaaaagaaccgagagatgctggaacttctgataagacacttggtcaatgtgtgtgagcacagcaaagagaatcttatgaccccctccaacatgggagtaatctttgggcccaccctgatgagagctcaggaggacactgtggccgccatgatgaacatcaaattccagaacatagtggtggaaatactaatcgagcactttggcaagatctatttaggtccacctgaggaaagcgctgcaccgccagtgcctccgcctcgggtgacagcaagaaggcacaaaccaatcacgatttcaaagcgcttgctgcgagaaaggacggttttctatacttcttccctggatgaaagcgaagatgaaatccaacatcaaacaccgaatggtactatcaccagcagcatagaaccccccaagccaccacaacaccccaaactacctattcagaggagtggggaaactgatcctgggaggaagtccccaagcaggcctattttggatggcaagttggagccctgcccagaggtggacgtggggaagttggtgtctaggctgcaggatggagggaccaagatcaccccaaaggccaccaatggacccatgccaggctctgggcccaccaagaccccctctttccacataaagagaccagctccccggcccctggcccaccacaaggagggggatgctgacagtttcagcaaagtgcggcctccaggagaaaagccaaccatcatccgccccccagtgaggcccccagatcctccctgccgggcagctactccccaaaagccagaaccaaagccagatattgtggctggcaatgcgggggaaatcacatcatctgtggtggcttccaggaccaggttttttgaaacagcttcccggaaaacaggaagttctcaaggcagacttcctggagatgaaagttgaggctacaggttttaaaagccttggcctcagaggaccctttccaggttctgaaagagtctttcttcttcaaacctttgtgtgcggagtcattttgtgttgaagagcagctccttcctagccttgcactttcagactctctctgggaggccataaaataaggagcatatgtcctagacaggtgtttatatctcctttgtattctgtcttcatcccctcagaaggtctgttttgagttcctataacactgtgaagagctggactccctcaagccagactctgccaaaaccaagatatccacttacctgagttgaagaggggagctcagttttcaactcttccctgaacttcctgcttcctcagagggccattgaactctgagagatttggggctaaagactgatctcaggggtcttaccttgaactgaaggccacttgagttggggccattgcttaccttggttggaagggaatagaaatgtttgctgaacattggagaatctcaacatgtctcctactgaggatatggacactggtgccatgtcagcgctctggtgctgcagtatgttgccaagagcccgtctgctcctgcgaggctatgagtgggatgagtgatgcccccacagcacctccatgtggacttaggaaggtggccttcctgctgttacatgcagccacttaggacaaatctgcaaagcatgttttgcatgtaaaagcctaggtctatttggattattctttctccttttttttgacagcttcctgtcaagcaatcaagaaacaaacaaaagctgaacacatttctttttaaaaaaaggagactgtgtttggtcctgtaggagttctattttggggtcaaatgctagaaaaattgttaaggtggattgaggccaggcagctgtcactgctgcttcatgtttgccttctgcacataaactcttttatctcctgaaaaaagcagttcttaacccagtgtccatggactcagaaactccatgatgcccctgagatggtatgcacaattccatgacaatatgccctttctggggagatagtccataatgttctgctaaatttcaaatgggctcgtgacccaaaaaagtcaagaaccacagcacttgagttaaaatactctttttacaatccatataagcccttgattggaagggcttttcaaaatcatttagtctaacaactgcccagtttccagtcgggggaactgaggcagagcaaggtagtgatcacaccagtacaagatttcaggtcccaggctcctatgcaagttttttttccccattatatcacacttatttagcaagggaccttgtggtttgtggctttagtggccatcatttctgggggttggcttttaccctttttcttgaatatttgccaccaagtgaaaaatgttaggacataaacccttgccaggtccctttcatttgctatctctattattggaaaggacctaaaaattggtgtaatggggcagaaatctgaggaatggacatttctaattcctgtttgttgaagggaagttgctggaaagagcatcagtacttgtttctatgcagatgcctgggccgtagcttgtctgtagcgtctgtataattataatgttgcccagtgtgagggaaagagctttcctacttgcactcttctaccaaggccctgttagtgcactgattatagtactgacagataaagcctagatgagagagatagagagtgagtacatgcacactcatgtgcaaacccactcagagatgcatttggaacagtgctactgaaaggcagtagtcattttcaagactgaattccaaacatggtttattggtgagttaggaacatgtaaggccaagtacactgagagcctttttgaaagtaattgagtggaaacttgatgccattctaaatcaaggcatatccaggtggcccggttgaactcactccactgtacccagtctcaaaggccaggttgctaagaaaccaggagtaaaagagtcaagtgaccatcatttcacctgctgcttgcccccaatagtagtctctgtgaggccttactgacctcacctaggaagtgatttttgagcccttgtttcagggctgtggcctccctgctctatcctgaataaagcagacaggtgtgcagattttggccatgaaagcatggctaatagggccacagtccctttaaagaaacatggtttgactctggttttcttgggggaaaataccacaatcaccgatgcaaacattggaagattattgagagccctagaaagctgctgtgatcccagtatcaagggcctatcttggagagctggggaccagcagtctgcctggaggccagggagcagtggctgagtagctctgcctttgctctggtctataccttaagaatgccaaagaatgaatttcaacgcctgcctttggcactctgacttaaagtgcaaaaagcttctgtggcgaggcatgctatcatggaatgagactggcttgccctaggcttaatggatgggcagtcattttgcagaggctatgggaagagggtgataatagaagagtggcagctataggaaattatcaacataccttggccagcaagttagagaatctggcaatggatgaactgaaagtgatgaactggcagggataacaaagaacctaacatttattaagcacgtatttattaactgctcagtgtttcatattcatgcaagtattctcattttacagagaaagaaattatggcccagggggctaaagtaaacaactcaagggcacatagaaagtaaataaaaggactgtgatttgaatccaggccactcttagcccatgctgttttccctttgccacactgtggtaggtgtttgaacagaggccacattactagagttggcatgactcttgactcttgcctgcctaacaaaatattgaaaggcaaacatttgaaggagggagggggtgcaggttcagtttatatggaaatgcaaactgggctggaagatattcctgagttaggctttctcttcatattcagcttgcacatttggtaatgtttttaagatgatcatctaattttattttgtgaagtgaaggatttgtgttttagttggcagttgttaagtccttggcttgccatttttcaaaaagtaaaaaggtcctcacaggtgtctccatacttcgccaaggttgtagcatgggcagtttcagtttcagcctaagagactggtgacatccacaaatgcagttttagaagcagaaaaggtcttggtgcctctgcagtacttgatgtattggggtcaaatctctacaaatttttctgtggtgatagcaaaatcaagagatggcttacaaaaagaaatattgaatttttatttttgaagtttttgttttttaaaaggttgggggtgttcagccactgagggacaaaacttagcatctaatttcaattatagtgtcatgcagagtatttctaaagtaattggttatcatgggaaagtattctcttttcaagaagttctttgattctgtaataactagaacaaataaagtagtaaaagaagaaatagttctgtgactaggaaaaaattgcttttgagagaacatagatcaattatactacttctaaggtagctgcagataagtggccttgacacattacaagcctggaaaaaaacatcagaaataataaaaaatttcagagagaatcaagatacctttttttttcttttttttttcttttttttattatactctaagttttagggtacatgtgcacattgtgcaggttagttacatatgtatacatgtgccatgctggtgcgctgcacccactaatgtgtcatctagcattaggtatatctcccagtgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtccaaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcgaaggacaagataccttaaagataagttttcgataaagaaaagccttcattttcctgggggaaatgaagcacttgatgccaaggacattagtagagggctagaaagattgcctgtgtgaaagacatatgctatatccaaataataaaacaaacgagatcctggggctcattcatgtgactttcaataaagtatgtagactgtctaatataagtggcc

SEQ ID NO: 298581 - DNA, 4795 bp, Homo sapiens
aaggaaggtggatgggaataggtttccagctggaagtttatctagtctgacaacctggattaccgcctaggagctattcactccctggtatataagctaccagaaaagaaccgagagatgctggaacttctgataagacacttggtcaatgtgtgtgagcacagcaaagagaatcttatgaccccctccaacatgggagtaatctttgggcccaccctgatgagagctcaggaggacactgtggccgccatgatgaacatcaaattccagaacatagtggtggaaatactaatcgagcactttggcaagatctatttaggtccacctgaggaaagcgctgcaccgccagtgcctccgcctcgggtgacagcaagaaggcacaaaccaatcacgatttcaaagcgcttgctgcgagaaaggacggttttctatacttcttccctggatgaaagcgaagatgaaatccaacatcaaacaccgaatggtactatcaccagcagcatagaaccccccaagccaccacaacaccccaaactacctattcagaggagtggggaaactgatcctgggaggaagtccccaagcaggcctattttggatggcaagttggagccctgcccagaggtggacgtggggaagttggtgtctaggctgcaggatggagggaccaagatcaccccaaaggccaccaatggacccatgccaggctctgggcccaccaagaccccctctttccacataaagagaccagctccccggcccctggcccaccacaaggagggggatgctgacagtttcagcaaagtgcggcctccaggagaaaagccaaccatcatccgccccccagtgaggcccccagatcctccctgccgggcagctactccccaaaagccagaaccaaagccagatattgtggctggcaatgcgggggaaatcacatcatctgtggtggcttccaggaccaggttttttgaaacagcttcccggaaaacaggaagttctcaaggcagacttcctggagatgaaagttgaggctacaggttttaaaagccttggcctcagaggaccctttccaggttctgaaagagtctttcttcttcaaacctttgtgtgcggagtcattttgtgttgaagagcagctccttcctagccttgcactttcagactctctctgggaggccataaaataaggagcatatgtcctagacaggtgtttatatctcctttgtattctgtcttcatcccctcagaaggtctgttttgagttcctataacactgtgaagagctggactccctcaagccagactctgccaaaaccaagatatccacttacctgagttgaagaggggagctcagttttcaactcttccctgaacttcctgcttcctcagagggccattgaactctgagagatttggggctaaagactgatctcaggggtcttaccttgaactgaaggccacttgagttggggccattgcttaccttggttggaagggaatagaaatgtttgctgaacattggagaatctcaacatgtctcctactgaggatatggacactggtgccatgtcagcgctctggtgctgcagtatgttgccaagagcccgtctgctcctgcgaggctatgagtgggatgagtgatgcccccacagcacctccatgtggacttaggaaggtggccttcctgctgttacatgcagccacttaggacaaatctgcaaagcatgttttgcatgtaaaagcctaggtctatttggattattctttctccttttttttgacagcttcctgtcaagcaatcaagaaacaaacaaaagctgaacacatttctttttaaaaaaaggagactgtgtttggtcctgtaggagttctattttggggtcaaatgctagaaaaattgttaaggtggattgaggccaggcagctgtcactgctgcttcatgtttgccttctgcacataaactcttttatctcctgaaaaaagcagttcttaacccagtgtccatggactcagaaactccatgatgcccctgagatggtatgcacaattccatgacaatatgccctttctggggagatagtccataatgttctgctaaatttcaaatgggctcgtgacccaaaaaagtcaagaaccacagcacttgagttaaaatactctttttacaatccatataagcccttgattggaagggcttttcaaaatcatttagtctaacaactgcccagtttccagtcgggggaactgaggcagagcaaggtagtgatcacaccagtacaagatttcaggtcccaggctcctatgcaagttttttttccccattatatcacacttatttagcaagggaccttgtggtttgtggctttagtggccatcatttctgggggttggcttttaccctttttcttgaatatttgccaccaagtgaaaaatgttaggacataaacccttgccaggtccctttcatttgctatctctattattggaaaggacctaaaaattggtgtaatggggcagaaatctgaggaatggacatttctaattcctgtttgttgaagggaagttgctggaaagagcatcagtacttgtttctatgcagatgcctgggccgtagcttgtctgtagcgtctgtataattataatgttgcccagtgtgagggaaagagctttcctacttgcactcttctaccaaggccctgttagtgcactgattatagtactgacagataaagcctagatgagagagatagagagtgagtacatgcacactcatgtgcaaacccactcagagatgcatttggaacagtgctactgaaaggcagtagtcattttcaagactgaattccaaacatggtttattggtgagttaggaacatgtaaggccaagtacactgagagcctttttgaaagtaattgagtggaaacttgatgccattctaaatcaaggcatatccaggtggcccggttgaactcactccactgtacccagtctcaaaggccaggttgctaagaaaccaggagtaaaagagtcaagtgaccatcatttcacctgctgcttgcccccaatagtagtctctgtgaggccttactgacctcacctaggaagtgatttttgagcccttgtttcagggctgtggcctccctgctctatcctgaataaagcagacaggtgtgcagattttggccatgaaagcatggctaatagggccacagtccctttaaagaaacatggtttgactctggttttcttgggggaaaataccacaatcaccgatgcaaacattggaagattattgagagccctagaaagctgctgtgatcccagtagaaaatatgtcccagaaatgtcatgagattgctgtgtgttgcctgggacacagatcaagggcctatcttggagagctggggaccagcagtctgcctggaggccagggagcagtggctgagtagctctgcctttgctctggtctataccttaagaatgccaaagaatgaatttcaacgcctgcctttggcactctgacttaaagtgcaaaaagcttctgtggcgaggcatgctatcatggaatgagactggcttgccctaggcttaatggatgggcagtcattttgcagaggctatgggaagagggtgataatagaagagtggcagctataggaaattatcaacataccttggccagcaagttagagaatctggcaatggatgaactgaaagtgatgaactggcagggataacaaagaacctaacatttattaagcacgtatttattaactgctcagtgtttcatattcatgcaagtattctcattttacagagaaagaaattatggcccagggggctaaagtaaacaactcaagggcacatagaaagtaaataaaaggactgtgatttgaatccaggccactcttagcccatgctgttttccctttgccacactgtggtaggtgtttgaacagaggccacattactagagttggcatgactcttgactcttgcctgcctaacaaaatattgaaaggcaaacatttgaaggagggagggggtgcaggttcagtttatatggaaatgcaaactgggctggaagatattcctgagttaggctttctcttcatattcagcttgcacatttggtaatgtttttaagatgatcatctaattttattttgtgaagtgaaggatttgtgttttagttggcagttgttaagtccttggcttgccatttttcaaaaagtaaaaaggtcctcacaggtgtctccatacttcgccaaggttgtagcatgggcagtttcagtttcagcctaagagactggtgacatccacaaatgcagttttagaagcagaaaaggtcttggtgcctctgcagtacttgatgtattggggtcaaatctctacaaatttttctgtggtgatagcaaaatcaagagatggcttacaaaaagaaatattgaatttttatttttgaagtttttgttttttaaaaggttgggggtgttcagccactgagggacaaaacttagcatctaatttcaattatagtgtcatgcagagtatttctaaagtaattggttatcatgggaaagtattctcttttcaagaagttctttgattctgtaataactagaacaaataaagtagtaaaagaagaaatagttctgtgactaggaaaaaattgcttttgagagaacatagatcaattatactacttctaaggtagctgcagataagtggccttgacacattacaagcctggaaaaaaacatcagaaataataaaaaatttcagagaga

SEQ ID NO: 298582 - DNA, 1277 bp, Homo sapiens
gcgcatgtgcaaggtgtccaaactgacaatgctggagagatagcgagtgtggattgagagaaagggagagagggagggagagagagtgaaagaagaaaatacagagagtgagtgtgtggaagagagagagaaacaggagagaaacaggagggggggagagagagagagagagagagagagagagagagagagagagagagagagacaggagagagagggagggagcgagagggagagcaaaagaaggaaaggatccaagaaaaaaaagccccaaccacacaccagaggctgcaggactgggcacagcatgagatccaaaggcagggcaaggaaactggccacaaataatgagtgtgtatatggcaactaccctgaaatacctttggaagaaatgccagatgcagatggagtagccagcactccctccctcaatattcaagagccatgctctcctgccacatccagtgaagcattcactccaaaggagggttctccttacaaagcccccatctacatccctgatgatatccccattcctgctgagtttgaacttcgagagtcaaatatgcctggggcaggactaggaatatggaccaaaaggaagatcgaagtaggtgaaaagtttgggccttatgtgggagagcagaggtcaaacctgaaagaccccagttatggatgggaggtacatcttccaaggtctcggagggtaagcgttcactcttggttgtatttggggaagagaagctcagacgtaggaatagccttctctcaggctgatgtctacatgcctggactgcagtgtgccttcctctcgtagctcggaaggacgcggaacctgggtggctggagccgcccgctgcgctttatttcggagcgcaatgccatctaccggcgtcctgccgtacctgcaagtatccagaccttgaaagtcgctccgcctccccccacccgaagccaatataggggaaaaaactcggaggccctttccacgaaatcctaatttagccaggacctgccaatgattccagacgaccttttgttttcctaccgacgtttcctcgttttgaaagcagttttgtaaagggcaaggaggtgggggccgcagggttggggcgctgagctcccagaccccctgatcaggcgcactgtctgaagcaatcggttccccagattacttgatatttaatacacaatgcatcataaaacaaatccctcatcctgacaggaagaaaatagaacagctcatagctcgagccagtccaatttatggctaaatt

SEQ ID NO: 298583 - DNA, 7194 bp, Homo sapiens
tttccaggcactctcattcatagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaactttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgcttggcggttacgcggcgctcgtgggtgttcgtgccttcggagcagctaaccggcgggtgctgggcgacggtggaggagtatcgttctcgctgcttgcccgagtcagggctgagtcaccccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgtttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaaataatgagtgtgtatatggcaactaccctgaaatacctttggaagaaatgccagatgcagatggagtagccagcactccctccctcaatattcaagagccatgctctcctgccacatccagtgaagcattcactccaaaggagggttctccttacaaagcccccatctacatccctgatgatatccccattcctgctgagtttgaacttcgagagtcaaatatgcctggggcaggactaggaatatggaccaaaaggaagatcgaagtaggtgaaaagtttgggccttatgtgggagagcagaggtcaaacctgaaagaccccagttatggatgggagatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaaatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaaaaaagaaactatttattctcgatattttgttttgcacagcaaaggcagctgctgacttctggaagatcaatcaatgcgacttaaagtgattcagtgaaaacaaaaaacttggtgggctgaaggcatcttccagtttaccccaccttagggtatgggtgggtgagaagggcagttgagatggcagcattgatatgaatgaacactccatagaaactgaattctcttttgtacaagatcacctgacatgattgggaacagttgcttttaattacagatttaatttttttcttcgttaaagttttatgtaatttaaccctttgaagacagaagtagttggatgaaatgcacagtcaattattatagaaactgataacagggagtacttgttcccccttttgccttcttaagtacattgtttaaaactagggaaaaagggtatgtgtatattgtaaactatggatgttaacactcaaagaggttaagtcagtgaagtaacctattcatcaccagtaccgctgtaccactaataaattgtttgccaaatccttgtaataacatcttaattttagacaatcatgtcactgtttttaatgtttatttttttgtgtgtgttgcgtgtatcatgtatttatttgttggcaaactattgtttgttgattaaaatagcactgttccagtcagccactactttatgacgtctgaggcacacccctttccgaatttcaaggaccaaggtgacccgacctgtgtatgagagtgccaaatggtgtttggcttttcttaacattcctttttgtttgtttgttttgttttccttcttaatgaactaaatacgaatagatgcaacttagtttttgtaatactgaaatcgattcaattgtataaacgattataatttctttcatggaagcatgattcttctgattaaaaactgtactccatattttatgctggttgtctgcaagcttgtgcgatgttatgttcatgttaatcctatttgtaaaatgaagtgttcccaaccttatgttaaaagagagaagtaaataacagactgtattcagttattttgccctttattgaggaaccagatttgttttctttttgtttgtaatctcattttgaaataatcagcaagttgaggtactttcttcaaatgctttgtacaatataaactgttatgcctttcagtgcattactatgggaggagcaactaaaaaataaagacttacaaaaaggagt

SEQ ID NO: 298584 - DNA, 5949 bp, Homo sapiens
  misc_feature (994)..(994): n is a, c, g, or t
tccttttgctgttggttttttgaaagggcctttctctaaagtctacctaaacggtttttttttaagctatctttggaggtttgacagcttttaaaaacacaggagtgtgttatatgaaatgactgaagatgtgtcgttactttattttattcgagatttccgacacgattaagacatttgggagacaaatgcagttctgctagcaaatcaaaagtgaataattcacccagggggcaaacgtttctggagaaagctaagcttttgtcttggggcaagaatattgagaggaagaatgttaatatgatggtgaaatctttgaataatcgtataacagattagtaaaaagacattctttggaaatgaacctttttaaaaattaattttgctgttgacagtggcaatgctaataatgttaacacggaataaaattacacctacaatttttatgtgcagtgtatgtaatacttaactccctgcccctgtgaaagggtatgcttgaaagctagggggatggatgcttcttgactttgaaattaacaagttttccacgtctctctgcaaatatgaaatggaattagtattgcatttcactggctttattctatgtcctttattaaatatttctttggtgtgtcaggagaactgccttttcttttttcttttttttcttttttttcttttttttgccagtcaaggaaacaaacaacaaaagatcagccagaaaccaaacagactgaacaaaccaacaaaacccagcaacaaactccaacctttttactatttaaaaatgtgcattgctattatttatgtaccttctcaacatctgggatggggggaaatctcaagttgccatttgagttactcagcactgagagttgaagaaacatcttaaagtttgtaattttattgataacaaatttttagaatttgtcctcttaatagaaaggatgtttaagtgtacacttctgtcgttgttagtgtgaagaggcatccntgaaaaagaagagtttgatttctgtgtgtgtgtgtgtgtgtgtgtgtgtgtgtgtgtgtttaataatatccctatcttatgttcgatttttcttttttaaattttgggacgacttattgcccttcaatttcctcatggccaaaggtttattcatagggcttcttgactaaagcccttggagcactgggtttttcttgaagtatatgatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaaaaaagaaactatttattctcgatattttgttttgcacagcaaaggcagctgctgacttctggaagatcaatcaatgcgacttaaagtgattcagtgaaaacaaaaaacttggtgggctgaaggcatcttccagtttaccccaccttagggtatgggtgggtgagaagggcagttgagatggcagcattgatatgaatgaacactccatagaaactgaattctcttttgtacaagatcacctgacatgattgggaacagttgcttttaattacagatttaatttttttcttcgttaaagttttatgtaatttaaccctttgaagacagaagtagttggatgaaatgcacagtcaattattatagaaactgataacagggagtacttgttcccccttttgccttcttaagtacattgtttaaaactagggaaaaagggtatgtgtatattgtaaactatggatgttaacactcaaagaggttaagtcagtgaagtaacctattcatcaccagtaccgctgtaccactaataaattgtttgccaaatccttgtaataacatcttaattttagacaatcatgtcactgtttttaatgtttatttttttgtgtgtgttgcgtgtatcatgtatttatttgttggcaaactattgtttgttgattaaaatagcactgttccagtcagccactactttatgacgtctgaggcacacccctttccgaatttcaaggaccaaggtgacccgacctgtgtatgagagtgccaaatggtgtttggcttttcttaacattcctttttgtttgtttgttttgttttccttcttaatgaactaaatacgaatagatgcaacttagtttttgtaatactgaaatcgattcaattgtataaacgattataatttctttcatggaagcatgattcttctgattaaaaactgtactccatattttatgctggttgtctgcaagcttgtgcgatgttatgttcatgttaatcctatttgtaaaatgaagtgttcccaaccttatgttaaaagagagaagtaaataacagactgtattcagttattttgccctttattgaggaaccagatttgttttctttttgtttgtaatctcattttgaaataatcagcaagttgaggtactttcttcaaatgctttgtacaatataaactgttatgcctttcagtgcattactatgggaggagcaactaaaaaataaagacttacaaaaaggagt

SEQ ID NO: 298585 - DNA, 5704 bp, Homo sapiens
tccttttgctgttggttttttgaaagggcctttctctaaagtctacctaaacggtttttttttaagctatctttggaggtttgacagcttttaaaaacacaggagtgtgttatatgaaatgactgaagatgtgtcgttactttattttattcgagatttccgacacgattaagacatttgggagacaaatgcagttctgctagcaaatcaaaagtgaataattcacccagggggcaaacgtttctggagaaagctaagcttttgtcttggggcaagaatattgagaggaagaatgttaatatgatggtgaaatctttgaataatcgtataacagattagtaaaaagacattctttggaaatgaacctttttaaaaattaattttgctgttgacagtggcaatgctaataatgttaacacggaataaaattacacctacaatttttatgtgcagtgtatgtaatacttaactccctgcccctgtgaaagggtatgcttgaaagctagggggatggatgcttcttgactttgaaattaacaagttttccacgtctctctgcaaatatgaaatggaattagtattgcatttcactggctttattctatgtcctttattaaatatttctttggtgtgtcaggagaactgccttttcttttttcttttttttcttttttttcttttttttgccagtcaaggaaacaaacaacaaaagatcagccagaaaccaaacagactgaacaaaccaacaaaacccagcaacaaactccaacctttttactatttaaaaatgtgcattgctattatttatgtaccttctcaacatctgggatggggggaaatctcaagttgccatttgagttactcagcactgagagttgaagaaacatcttaaagtttattcatagggcttcttgactaaagcccttggagcactgggtttttcttgaagtatatgatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaaaaaagaaactatttattctcgatattttgttttgcacagcaaaggcagctgctgacttctggaagatcaatcaatgcgacttaaagtgattcagtgaaaacaaaaaacttggtgggctgaaggcatcttccagtttaccccaccttagggtatgggtgggtgagaagggcagttgagatggcagcattgatatgaatgaacactccatagaaactgaattctcttttgtacaagatcacctgacatgattgggaacagttgcttttaattacagatttaatttttttcttcgttaaagttttatgtaatttaaccctttgaagacagaagtagttggatgaaatgcacagtcaattattatagaaactgataacagggagtacttgttcccccttttgccttcttaagtacattgtttaaaactagggaaaaagggtatgtgtatattgtaaactatggatgttaacactcaaagaggttaagtcagtgaagtaacctattcatcaccagtaccgctgtaccactaataaattgtttgccaaatccttgtaataacatcttaattttagacaatcatgtcactgtttttaatgtttatttttttgtgtgtgttgcgtgtatcatgtatttatttgttggcaaactattgtttgttgattaaaatagcactgttccagtcagccactactttatgacgtctgaggcacacccctttccgaatttcaaggaccaaggtgacccgacctgtgtatgagagtgccaaatggtgtttggcttttcttaacattcctttttgtttgtttgttttgttttccttcttaatgaactaaatacgaatagatgcaacttagtttttgtaatactgaaatcgattcaattgtataaacgattataatttctttcatggaagcatgattcttctgattaaaaactgtactccatattttatgctggttgtctgcaagcttgtgcgatgttatgttcatgttaatcctatttgtaaaatgaagtgttcccaaccttatgttaaaagagagaagtaaataacagactgtattcagttattttgccctttattgaggaaccagatttgttttctttttgtttgtaatctcattttgaaataatcagcaagttgaggtactttcttcaaatgctttgtacaatataaactgttatgcctttcagtgcattactatgggaggagcaactaaaaaataaagacttacaaaaaggagt

SEQ ID NO: 298586 - DNA, 4977 bp, Homo sapiens
  misc_feature (994)..(994): n is a, c, g, or t
tccttttgctgttggttttttgaaagggcctttctctaaagtctacctaaacggtttttttttaagctatctttggaggtttgacagcttttaaaaacacaggagtgtgttatatgaaatgactgaagatgtgtcgttactttattttattcgagatttccgacacgattaagacatttgggagacaaatgcagttctgctagcaaatcaaaagtgaataattcacccagggggcaaacgtttctggagaaagctaagcttttgtcttggggcaagaatattgagaggaagaatgttaatatgatggtgaaatctttgaataatcgtataacagattagtaaaaagacattctttggaaatgaacctttttaaaaattaattttgctgttgacagtggcaatgctaataatgttaacacggaataaaattacacctacaatttttatgtgcagtgtatgtaatacttaactccctgcccctgtgaaagggtatgcttgaaagctagggggatggatgcttcttgactttgaaattaacaagttttccacgtctctctgcaaatatgaaatggaattagtattgcatttcactggctttattctatgtcctttattaaatatttctttggtgtgtcaggagaactgccttttcttttttcttttttttcttttttttcttttttttgccagtcaaggaaacaaacaacaaaagatcagccagaaaccaaacagactgaacaaaccaacaaaacccagcaacaaactccaacctttttactatttaaaaatgtgcattgctattatttatgtaccttctcaacatctgggatggggggaaatctcaagttgccatttgagttactcagcactgagagttgaagaaacatcttaaagtttgtaattttattgataacaaatttttagaatttgtcctcttaatagaaaggatgtttaagtgtacacttctgtcgttgttagtgtgaagaggcatccntgaaaaagaagagtttgatttctgtgtgtgtgtgtgtgtgtgtgtgtgtgtgtgtgtgtttaataatatccctatcttatgttcgatttttcttttttaaattttgggacgacttattgcccttcaatttcctcatggccaaaggtttattcatagggcttcttgactaaagcccttggagcactgggtttttcttgaagtatatgatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaaaaaagaaactatttattctcgatattttgttttgcacagcaaaggcagctgctgacttctggaagatcaatcaatgcgacttaaagtgattcagtgaaaacaaaaaacttggtgggctgaaggcatcttccagtttaccccaccttagggtatgggtgggtgagaagggcagttgagatggcagcattgatatgaatgaacactccatagaaactgaattctcttttgtacaagatcacctgacatgattgggaacagttgcttttaattacagatttaatttttttcttcgttaaagttttatgtaatttaaccctttgaagacagaagtagttggatgaaatgcacagtcaattattatagaaactgataacagggagtacttgttcccccttttgccttcttaagtacattgtttaaaactagggaaaaagggtatgtgtatattgtaaactatggatgttaacactcaaagaggttaagtcagtgaagtaacctattcatcaccagtaccgctgtaccactaataaattgtttgccaaatccttgtaataacatcttaattttagacaatcatgtcactgtttttaatgtttatttttttgtgtgtgttgcgtgtatcatgtatttatttgttggcaaactattgtttgttgattaaaatagcactgttccagtcagccactactttatgacgtctgaggcacacccctttccgaatttcaaggaccaaggtgacccgacctgtgtatgagagtgccaaatggtgtttggcttttcttaacattcctttttgtttgtttgttttgttttccttcttaatgaactaaatacgaatagatgcaacttagtttttgtaatactgaaatcgattcaattgtataaacgattataatttctttcatggaagcatgattcttctgattaaaaactgtactccatattttatgctggttgtctgcaagcttgtgcgatgttatgttcatgttaatcctatttgtaaaatgaagtgttcccaaccttatgttaaaagagagaagtaaataacagactgtattcagttattttgccctttattgaggaaccagatttgttttctttttgtttgtaatctcattttgaaataatcagcaagttgaggtactttcttcaaatgctttgtacaatataaactgttatgcctttcagtgcattactatgggaggagcaactaaaaaataaagacttacaaaaaggagt

SEQ ID NO: 298587 - DNA, 5265 bp, Homo sapiens
tccttttgctgttggttttttgaaagggcctttctctaaagtctacctaaacggtttttttttaagctatctttggaggtttgacagcttttaaaaacacaggagtgtgttatatgaaatgactgaagatgtgtcgttactttattttattcgagatttccgacacgattaagacatttgggagacaaatgcagttctgctagcaaatcaaaagtgaataattcacccagggggcaaacgtttctggagaaagctaagcttttgtcttggggcaagaatattgagaggaagaatgttaatatgatggtgaaatctttgaataatcgtataacagattagtaaaaagacattctttggaaatgaacctttttaaaaattaattttgctgttgacagtggcaatgctaataatgttaacacggaataaaattacacctacaatttttatgtgcagtgtttattcatagggcttcttgactaaagcccttggagcactgggtttttcttgaagtatatgatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaaaaaagaaactatttattctcgatattttgttttgcacagcaaaggcagctgctgacttctggaagatcaatcaatgcgacttaaagtgattcagtgaaaacaaaaaacttggtgggctgaaggcatcttccagtttaccccaccttagggtatgggtgggtgagaagggcagttgagatggcagcattgatatgaatgaacactccatagaaactgaattctcttttgtacaagatcacctgacatgattgggaacagttgcttttaattacagatttaatttttttcttcgttaaagttttatgtaatttaaccctttgaagacagaagtagttggatgaaatgcacagtcaattattatagaaactgataacagggagtacttgttcccccttttgccttcttaagtacattgtttaaaactagggaaaaagggtatgtgtatattgtaaactatggatgttaacactcaaagaggttaagtcagtgaagtaacctattcatcaccagtaccgctgtaccactaataaattgtttgccaaatccttgtaataacatcttaattttagacaatcatgtcactgtttttaatgtttatttttttgtgtgtgttgcgtgtatcatgtatttatttgttggcaaactattgtttgttgattaaaatagcactgttccagtcagccactactttatgacgtctgaggcacacccctttccgaatttcaaggaccaaggtgacccgacctgtgtatgagagtgccaaatggtgtttggcttttcttaacattcctttttgtttgtttgttttgttttccttcttaatgaactaaatacgaatagatgcaacttagtttttgtaatactgaaatcgattcaattgtataaacgattataatttctttcatggaagcatgattcttctgattaaaaactgtactccatattttatgctggttgtctgcaagcttgtgcgatgttatgttcatgttaatcctatttgtaaaatgaagtgttcccaaccttatgttaaaagagagaagtaaataacagactgtattcagttattttgccctttattgaggaaccagatttgttttctttttgtttgtaatctcattttgaaataatcagcaagttgaggtactttcttcaaatgctttgtacaatataaactgttatgcctttcagtgcattactatgggaggagcaactaaaaaataaagacttacaaaaaggagt

SEQ ID NO: 298588 - DNA, 4873 bp, Homo sapiens
tttgcgtccaacatcgtgtgctgcttcgcgagaaagtcacattcggaccctttggctagattgtttattcatagggcttcttgactaaagcccttggagcactgggtttttcttgaagtatatgatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaaaaaagaaactatttattctcgatattttgttttgcacagcaaaggcagctgctgacttctggaagatcaatcaatgcgacttaaagtgattcagtgaaaacaaaaaacttggtgggctgaaggcatcttccagtttaccccaccttagggtatgggtgggtgagaagggcagttgagatggcagcattgatatgaatgaacactccatagaaactgaattctcttttgtacaagatcacctgacatgattgggaacagttgcttttaattacagatttaatttttttcttcgttaaagttttatgtaatttaaccctttgaagacagaagtagttggatgaaatgcacagtcaattattatagaaactgataacagggagtacttgttcccccttttgccttcttaagtacattgtttaaaactagggaaaaagggtatgtgtatattgtaaactatggatgttaacactcaaagaggttaagtcagtgaagtaacctattcatcaccagtaccgctgtaccactaataaattgtttgccaaatccttgtaataacatcttaattttagacaatcatgtcactgtttttaatgtttatttttttgtgtgtgttgcgtgtatcatgtatttatttgttggcaaactattgtttgttgattaaaatagcactgttccagtcagccactactttatgacgtctgaggcacacccctttccgaatttcaaggaccaaggtgacccgacctgtgtatgagagtgccaaatggtgtttggcttttcttaacattcctttttgtttgtttgttttgttttccttcttaatgaactaaatacgaatagatgcaacttagtttttgtaatactgaaatcgattcaattgtataaacgattataatttctttcatggaagcatgattcttctgattaaaaactgtactccatattttatgctggttgtctgcaagcttgtgcgatgttatgttcatgttaatcctatttgtaaaatgaagtgttcccaaccttatgttaaaagagagaagtaaataacagactgtattcagttattttgccctttattgaggaaccagatttgttttctttttgtttgtaatctcattttgaaataatcagcaagttgaggtactttcttcaaatgctttgtacaatataaactgttatgcctttcagtgcattactatgggaggagcaactaaaaaataaagacttacaaaaaggagt

SEQ ID NO: 298589 - DNA, 5431 bp, Homo sapiens
gcgcatgtgcaaggtgtccaaactgacaatgctggagagatagcgagtgtggattgagagaaagggagagagggagggagagagagtgaaagaagaaaatacagagagtgagtgtgtggaagagagagagaaacaggagagaaacaggagggggggagagagagagagagagagagagagagagagagagagagagagagagagacaggagagagagggagggagcgagagggagagcaaaagaaggaaaggatccaagaaaaaaaagccccaaccacacaccagaggctgcaggactgggcacagcatgagatccaaaggcagggcaaggaaactggccacaaataatgagtgtgtatatggcaactaccctgaaatacctttggaagaaatgccagatgcagatggagtagccagcactccctccctcaatattcaagagccatgctctcctgccacatccagtgaagcattcactccaaaggagggttctccttacaaagcccccatctacatccctgatgatatccccattcctgctgagtttgaacttcgagagtcaaatatgcctggggcaggactaggaatatggaccaaaaggaagatcgaagtaggtgaaaagtttgggccttatgtgggagagcagaggtcaaacctgaaagaccccagttatggatgggagatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaattccaactgcctgatcagagaacttggatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaaaaaagaaactatttattctcgatattttgttttgcacagcaaaggcagctgctgacttctggaagatcaatcaatgcgacttaaagtgattcagtgaaaacaaaaaacttggtgggctgaaggcatcttccagtttaccccaccttagggtatgggtgggtgagaagggcagttgagatggcagcattgatatgaatgaacactccatagaaactgaattctcttttgtacaagatcacctgacatgattgggaacagttgcttttaattacagatttaatttttttcttcgttaaagttttatgtaatttaaccctttgaagacagaagtagttggatgaaatgcacagtcaattattatagaaactgataacagggagtacttgttcccccttttgccttcttaagtacattgtttaaaactagggaaaaagggtatgtgtatattgtaaactatggatgttaacactcaaagaggttaagtcagtgaagtaacctattcatcaccagtaccgctgtaccactaataaattgtttgccaaatccttgtaataacatcttaattttagacaatcatgtcactgtttttaatgtttatttttttgtgtgtgttgcgtgtatcatgtatttatttgttggcaaactattgtttgttgattaaaatagcactgttccagtcagccactactttatgacgtctgaggcacacccctttccgaatttcaaggaccaaggtgacccgacctgtgtatgagagtgccaaatggtgtttggcttttcttaacattcctttttgtttgtttgttttgttttccttcttaatgaactaaatacgaatagatgcaacttagtttttgtaatactgaaatcgattcaattgtataaacgattataatttctttcatggaagcatgattcttctgattaaaaactgtactccatattttatgctggttgtctgcaagcttgtgcgatgttatgttcatgttaatcctatttgtaaaatgaagtgttcccaaccttatgttaaaagagagaagtaaataacagactgtattcagttattttgccctttattgaggaaccagatttgttttctttttgtttgtaatctcattttgaaataatcagcaagttgaggtactttcttcaaatgctttgtacaatataaactgttatgcctttcagtgcattactatgggaggagcaactaaaaaataaagacttacaaaaaggagt

SEQ ID NO: 298590 - DNA, 2339 bp, Homo sapiens
gtactaccagctgatgtgtggcctgtgtgggaactacaacggcgaccccaaggatgacttccagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggcatatgctatgatgctgtcactgtctgacaaggagtccctccattctacatcccacagttcttccaacgtgtggcacagtatggccagggctgcggcggaatccagtgctatccagtccataagccacgtatgacgttatcaaggttgaccagagtgggaccaagtccaacagtagcatggctctttcatataggactatttacaagactgctgagcagaatgccttataaacctgcagggtcactcatctaaagtctagtgaccttaaactgaatgatttaaaaaagaaaagaaagaaaaaagaaactatttattctcgatattttgttttgcacagcaaaggcagctgctgacttctggaagatcaatcaatgcgacttaaagtgattcagtgaaaacaaaaaacttggtgggctgaaggcatcttccagtttaccccaccttagggtatgggtgggtgagaagggcagttgagatggcagcattgatatgaatgaacactccatagaaactgaattctcttttgtacaagatcacctgacatgattgggaacagttgcttttaattacagatttaatttttttcttcgttaaagttttatgtaatttaaccctttgaagacagaagtagttggatgaaatgcacagtcaattattatagaaactgataacagggagtacttgttcccccttttgccttcttaagtacattgtttaaaactagggaaaaagggtatgtgtatattgtaaactatggatgttaacactcaaagaggttaagtcagtgaagtaacctattcatcaccagtaccgctgtaccactaataaattgtttgccaaatccttgtaataacatcttaattttagacaatcatgtcactgtttttaatgtttatttttttgtgtgtgttgcgtgtatcatgtatttatttgttggcaaactattgtttgttgattaaaatagcactgttccagtcagccactactttatgacgtctgaggcacacccctttccgaatttcaaggaccaaggtgacccgacctgtgtatgagagtgccaaatggtgtttggcttttcttaacattcctttttgtttgtttgttttgttttccttcttaatgaactaaatacgaatagatgcaacttagtttttgtaatactgaaatcgattcaattgtataaacgattataatttctttcatggaagcatgattcttctgattaaaaactgtactccatattttatgctggttgtctgcaagcttgtgcgatgttatgttcatgttaatcctatttgtaaaatgaagtgttcccaaccttatgttaaaagagagaagtaaataacagactgtattcagttattttgccctttattgaggaaccagatttgttttctttttgtttgtaatctcattttgaaataatcagcaagttgaggtactttcttcaaatgctttgtacaatataaactgttatgcctttcagtgcattactatgggaggagcaactaaaaaataaagacttacaaaaaggagt

SEQ ID NO: 298591 - DNA, 5184 bp, Homo sapiens
  misc_feature (994)..(994): n is a, c, g, or t
  misc_feature (5181)..(5183): n is a, c, g, or t
tccttttgctgttggttttttgaaagggcctttctctaaagtctacctaaacggtttttttttaagctatctttggaggtttgacagcttttaaaaacacaggagtgtgttatatgaaatgactgaagatgtgtcgttactttattttattcgagatttccgacacgattaagacatttgggagacaaatgcagttctgctagcaaatcaaaagtgaataattcacccagggggcaaacgtttctggagaaagctaagcttttgtcttggggcaagaatattgagaggaagaatgttaatatgatggtgaaatctttgaataatcgtataacagattagtaaaaagacattctttggaaatgaacctttttaaaaattaattttgctgttgacagtggcaatgctaataatgttaacacggaataaaattacacctacaatttttatgtgcagtgtatgtaatacttaactccctgcccctgtgaaagggtatgcttgaaagctagggggatggatgcttcttgactttgaaattaacaagttttccacgtctctctgcaaatatgaaatggaattagtattgcatttcactggctttattctatgtcctttattaaatatttctttggtgtgtcaggagaactgccttttcttttttcttttttttcttttttttcttttttttgccagtcaaggaaacaaacaacaaaagatcagccagaaaccaaacagactgaacaaaccaacaaaacccagcaacaaactccaacctttttactatttaaaaatgtgcattgctattatttatgtaccttctcaacatctgggatggggggaaatctcaagttgccatttgagttactcagcactgagagttgaagaaacatcttaaagtttgtaattttattgataacaaatttttagaatttgtcctcttaatagaaaggatgtttaagtgtacacttctgtcgttgttagtgtgaagaggcatccntgaaaaagaagagtttgatttctgtgtgtgtgtgtgtgtgtgtgtgtgtgtgtgtgtgtttaataatatccctatcttatgttcgatttttcttttttaaattttgggacgacttattgcccttcaatttcctcatggccaaaggtttattcatagggcttcttgactaaagcccttggagcactgggtttttcttgaagtatatgatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtgaggtctgccataaatcctatactcagttttcaaacctttgccgtcataagcgcatgcatgctgattgcagaacccaaatcaagtgcaaagactgtggacaaatgttcagcactacgtcttccttaaataaacacaggaggttttgtgagggcaagaaccattttgcggcaggtggattttttggccaaggcatttcacttcctggaaccccagctatggataaaacgtccatggttaatatgagtcatgccaacccgggccttgctgactattttggcgccaataggcatcctgctggtcttacctttccaacagctcctggattttcttttagcttccctggtctgtttccttccggcttgtaccacaggcctcctttgatacctgctagttctcctgttaaaggactatcaagtactgaacagacaaacaaaagtcaaagtcccctcatgacacatcctcagatactgccagctacacaggatattttgaaggcactatctaaacacccatctgtaggggacaataagccagtggagctccagcccgagaggtcctctgaagagaggccctttgagaaaatcagtgaccagtcagagagtagtgaccttgatgatgtcagtacaccaagtggcagtgacctggaaacaacctcgggctctgatctggaaagtgacattgaaagtgataaagagaaatttaaagaaaatggtaaaatgttcaaagacaaagtaagccctcttcagaatctggcttcaataaataataagaaagaatacagcaatcattccattttctcaccatctttagaggagcagactgcggtgtcaggagctgtgaatgattctataaaggctattgcttctattgctgaaaaatactttggttcaacaggactggtggggctgcaagacaaaaaagttggagctttaccttacccttccatgtttcccctcccattttttccagcattctctcaatcaatgtacccatttcctgatagagacttgagatcgttacctttgaaaatggaaccccaatcaccaggtgaagtaaagaaactgcagaagggcagctctgagtccccctttgatctcaccactaagcgaaaggatgagaagcccttgactccagtcccctccaagcctccagtgacacctgccacaagccaagaccagcccctggatctaagtatgggcagtaggagtagagccagtgggacaaagctgactgagcctcgaaaaaaccacgtgtttgggggaaaaaaaggaagcaacgtcgaatcaagacctgcttcagatggttccttgcagcatgcaagacccactcctttctttatggaccctatttacagagtagagaaaagaaaactaactgacccacttgaagctttaaaagagaaatacttgaggccttctccaggattcttgtttcacccacaaatgtcagctattgaaaacatggcagaaaagctagagagcttcagtgccctgaaacctgaggccagtgagctcttacagtcagtgccctctatgttcaacttcagggcgcctcccaatgccctgccagagaaccttctgcggaagggaaaggagcgctatacctgcagatactgtggcaagatttttccaaggtctgcaaacctaacacggcacttgagaacccacacaggagagcagccttacagatgcaaatactgtgacagatcatttagcatatcttctaacttgcaaaggcatgttcgcaacatccacaataaagagaagccatttaagtgtcacttatgtgataggtgttttggtcaacaaaccaatttagacagacacctaaagaaacatgagaatgggaacatgtccggtacagcaacatcgtcgcctcattctgaactggaaagtacaggtgcgattctggatgacaaagaagatgcttacttcacagaaattcgaaatttcattgggaacagcaaccatggcagccaatctcccaggaatgtggaggagagaatgaatggcagtcattttaaagatgaaaaggctttggtgaccagtcaaaattcagacttgctggatgatgaagaagttgaagatgaggtgttgttagatgaggaggatgaagacaatgatattactggaaaaacaggaaaggaaccagtgacaagtaatttacatgaaggaaaccctgaggatgactatgaagaaaccagtgccctggagatgagttgcaagacatccccagtgaggtataaagaggaagaatataaaagtggactttctgctctagatcatataaggcacttcacagatagcctcaaaatgaggaaaatggaagataatcaatattctgaagctgagctgtcttcttttagtacttcccatgtgccagaggaacttaagcagccgttacacagaaagtccaaatcgcaggtacagattttcccatagtacagcatcatggttacattatgcatgaaacgtacatttcctttgattaccaaaaagcaaatattctatctttgaaatattttagaatccaaatggggtcagatgcctttctaaaaatgttcatatctttactgtatttatgaccaaatccaaaatagttaagcaagaaagcaattaatttagctgcattctgtatagaaattttatgacaagccccatcctacacttatctttccttgactttgcaattctcttacttttgtacagttagttcatcatgtttgtttacaaatatttatgtattacctcagagtcattttccgtgtctatacttttgtcaatgtaattatattttaagatttttctgaaaagtgaattctattttttgtccccttctatgtctagtaaattgttaggtgtagttaattagcaagtcatctcatgttgtaatttaatagtaaaatgaggatcagaaaggaagtgagttgccaaaggtctacaccaacttactggcagatttggaaataaaacctgtcaatttaaattcaacaaatgaatgagtgaatgaatggtactcaaatttattaggctctacaacattgtatcagcactatggtaactaaaaataaatctatttaagggtccataaatagcaattaaaagagcctcagtgtttttgttacaaaataaaggaagtcggtacttttttgtttgacatccacactcaaccggattgttcattcaggtcaattaaaaataaagaaacttcctattaccaannna

SEQ ID NO: 298592 - DNA, 2125 bp, Homo sapiens
  misc_feature (994)..(994): n is a, c, g, or t
tccttttgctgttggttttttgaaagggcctttctctaaagtctacctaaacggtttttttttaagctatctttggaggtttgacagcttttaaaaacacaggagtgtgttatatgaaatgactgaagatgtgtcgttactttattttattcgagatttccgacacgattaagacatttgggagacaaatgcagttctgctagcaaatcaaaagtgaataattcacccagggggcaaacgtttctggagaaagctaagcttttgtcttggggcaagaatattgagaggaagaatgttaatatgatggtgaaatctttgaataatcgtataacagattagtaaaaagacattctttggaaatgaacctttttaaaaattaattttgctgttgacagtggcaatgctaataatgttaacacggaataaaattacacctacaatttttatgtgcagtgtatgtaatacttaactccctgcccctgtgaaagggtatgcttgaaagctagggggatggatgcttcttgactttgaaattaacaagttttccacgtctctctgcaaatatgaaatggaattagtattgcatttcactggctttattctatgtcctttattaaatatttctttggtgtgtcaggagaactgccttttcttttttcttttttttcttttttttcttttttttgccagtcaaggaaacaaacaacaaaagatcagccagaaaccaaacagactgaacaaaccaacaaaacccagcaacaaactccaacctttttactatttaaaaatgtgcattgctattatttatgtaccttctcaacatctgggatggggggaaatctcaagttgccatttgagttactcagcactgagagttgaagaaacatcttaaagtttgtaattttattgataacaaatttttagaatttgtcctcttaatagaaaggatgtttaagtgtacacttctgtcgttgttagtgtgaagaggcatccntgaaaaagaagagtttgatttctgtgtgtgtgtgtgtgtgtgtgtgtgtgtgtgtgtgtttaataatatccctatcttatgttcgatttttcttttttaaattttgggacgacttattgcccttcaatttcctcatggccaaaggtttattcatagggcttcttgactaaagcccttggagcactgggtttttcttgaagtatatgatcttagacgaattttacaatgtgaagttctgcatagatgccagtcaaccagatgttggaagctggctcaagtacattagattcgctggctgttatgatcagcacaaccttgttgcatgccagataaatgatcagatattctatagagtagttgcagacattgcgccgggagaggagcttctgctgttcatgaagagcgaagactatccccatgaaactatggcgccggatatccacgaagaacggcaatatcgctgcgaagactgtgaccagctctttgaatctaaggctgaactagcagatcaccaaaagtttccatgcagtactcctcactcagcattttcaatggttgaagaggactttcagcaaaaactcgaaagcgagaatgatctccaagagatacacacgatccaggagtgtaaggaatgtgaccaagtttttcctgatttgcaaagcctggagaaacacatgctgtcacatactgaagagagggaatacaagtgtgatcagtgtcccaaggcatttaactggaagtccaatttaattcgccaccagatgtcacatgacagtggaaagcactatgaatgtgaaaactgtgccaaggttttcacggaccctagcaaccttcagcggcacattcgctctcagcatgtcggtgcccgggcccatgcatgcccggagtgtggcaaaacgtttgccacttcgtcgggcctcaaacaacacaagcacatccacagcagtgtgaagccctttatctgtaagttttcaacactccagccctccttcccacatctgtctcttccccaaaaggcactgtgaccaggagagtggctgcacatggcctttagagggtcaccgtgttagctatttatggtccaatccagtagggctatttatgattacaagtaaatcttttataatcaga

SEQ ID NO: 298593 - DNA, 3638 bp, Homo sapiens
  misc_feature (2687)..(2688): n is a, c, g, or t
  misc_feature (2772)..(2772): n is a, c, g, or t
  misc_feature (2849)..(2850): n is a, c, g, or t
tttccaggcactctcattcatagagccagcgggcgcgggcgggacgggcgccccgcggccggacccagccagggcaccacgctgcccggccctgcgccgccaggcacttctttccggggctcctagggacgccagaaggaagtcaacctctgctgcttctccttggcctgcgttggaccttcctttttttgttgtttttttttgtttttcccctttcttccttttgaattaactggcttcttggctggatgttttcaacttctttcctggctgcgaactttttccccaattgttttccttttacaacagggggagaaagtgctctgtggtccgaggcgagccgtgaagttgcgtgtgcgtggcagtgtgcgtggcaggatgtgcgtgcgtgtgtaacccgagccgcccgatctgtttcgatctgcgccgcggagccctccctcaaggcccgctccacctgcttggcggttacgcggcgctcgtgggtgttcgtgccttcggagcagctaaccggcgggtgctgggcgacggtggaggagtatcgttctcgctgcttgcccgagtcagggctgagtcaccccagctgatgtagacagtggctgccttccgaagagtgcgtgtttgcatgtgtgtgactctgcggctgctcaactcccaacaaaccagaggaccagccacaaacttaaccaacatccccaaacccgagttcacagatgtgggagagctgtagaaccctgagtgtcatcgactgggccttcttatgattgttgttttaagattagctgaagatctctgaaacgctgaattttctgcactgagcgtttgacagaattcattgagagaacagagaacatgacaagtacttctagctcagcactgctccaactactgaagctgattttcaaggctacttaaaaaaatctgcagcgtacattaatggatttctgttgtgtttaaattctccacagattgtattgtaaatattttatgaagtagagcatatgtatatatttatatatacgtgcacatacattagtagcactacctttggaagtctcagctcttgcttttcgggactgaagccagttttgcatgataaaagtggccttgttacgggagataattgtgttctgttgggactttagacaaaactcacctgcaaaaaactgacaggcattaactactggaacttccaaataatgtgtttgctgatcgttttactcttcgcataaatattttaggaagtgtatgagaattttgccttcaggaacttttctaacagccaaagacagaacttaacctctgcaagcaagattcgtggaagatagtctccactttttaatgcactaagcaatcggttgctaggagcccatcctgggtcagaggccgatccgcagaaccagaacgttttcccctcctggactgttagtaacttagtctccctcctcccctaaccacccccgcccccccccaccccccgcagtaataaaggcccctgaacgtgtatgttggtctcccgggagctgcttgctgaagatccgcgcccctgtcgccgtctggtaggagctgtttgcagggtcctaactcaatcggcttgttgtgatgcgtatccccgtagatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaaataatgagtgtgtatatggcaactaccctgaaatacctttggaagaaatgccagatgcagatggagtagccagcactccctccctcaatattcaagagccatgctctcctgccacatccagtgaagcattcactccaaaggagggttctccttacaaagcccccatctacatccctgatgatatccccattcctgctgagtttgaacttcgagagtcaaatatgcctggggcaggactaggaatatggaccaaaaggaagatcgaagtaggtgaaaagtttgggccttatgtgggagagcagaggtcaaacctgaaagaccccagttatggatgggaggtaagaatgtattttgagttaacacatttatatattgcagctgtgtaaagaagagattgtttaagcatccacaaaataagcaaattatatttgttacaatatgttttcaacaggtttttaagaataaacttcctttacaatctcacttcttaatacaaacaatgtattgattaaaggtatagcgtgataggagggaacccaacctaatatatggnnaaagaattgtactgatttgaaaaaatactaaaggaagaagatatgattttatagttaacgtttggaaacattggctatgaccangtgtagcatgtggcattagcaaacaagcataatcatatgacatgtttattgcattttatcttttttggggtgggganntggaggattggaggaaaacatttgttttctctattttgtgactatgagttaatttggttttattttcattttgtgctatgtttttctaatatattttgcctctcttttgataaccctgctttaattatacatgcttccagaatgtcagcactgtactcatcactgaattaggttatggttctttatattcaaatgatttaatgagtaatttgtgcatcaaaacagacgcacaaaatggttgtgaaaattagtcactcgtttcagtcatatttttcataaaatccatttggcaacatctaagaattagaagttatagtctgattaaagaatctaaattaaatttatttcaataaagacaggtaactatgttattcttctgagtgtaagttttatacagattcagtagatatatatatactttccatttatttctgtaacttgaaaacttttgtgcttgaatcattacatcataatttctggaaaatcttgtttctatctgaaaaacttgtagacagtttctgcaggggtaagatattttttagagatgtgattgacctttggtttcatagcatttcagtagacagaaatcagataaactggatttatttcggtatgtttccttaatatttatgatcattaatagaatatctggttagcttttaaatagaaatgaatattcagtgccttcaggacttaatttcaactttttgtcctcttgctttatatgtatcctcttgtgaaatctgttcaaaatgccataataaaagcaattcttgttcaaattctga

SEQ ID NO: 298594 - DNA, 363 bp, Homo sapiens
tttgggggaaaaaaaggaagcaacgtcgaatcaagacctgcttcagatggttccttgcagcatgcaagacccactcctttctttatggaccctatttacaggtaagcgtgtatggaagatgacgaaatatgagcagatgtatgaaaggcggtatttccactgtaaagtgatggctttttaacacatcatttttactattattataaaacagagtgaagttgtttgatctagtgaactcattttttattctgaaagttggatcattctgtttgaacttatttttggatgtttctgaagttgggggtttggaataggcctacagaatttttttcccttgacaataaatttatttttaaacacttt

SEQ ID NO: 298595 - DNA, 4925 bp, Homo sapiens
gaaacttccttattattgtgacgccgaaaacggagaaaccccgggtccggcgagaggggctgtgacagtcggagtcccaagctgcggttcggctgctgccgagaactgcaaggtgtggaatatttctggcttctagtccaatgccaagtgtgtgacctgtggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcccacagtctggccctcagtgaccgaggccagctgttttcttggggtgcagggagtgatggtcagctaggactcatgactactgaggattctgtggcagtgcccaggttaatacaaaagctgaaccagcaaacaatattacaagtttcctgtggcaactggcattgcttggctcttgcggctgatggccagttcttcacctggggaaagaacagccatgggcagcttggcttagggaaggagttcccctcccaagccagcccacagagggtgaggtccctggaggggatcccactggctcaggtggctgccggaggggctcacagctttgccctgtctctctcaggagctgtttttggctgggggatgaataatgccgggcagctagggctcagtgatgaaaaagatcgagaatctccatgccatgtaaaactcttacgcacgcaaaaagttgtctatattagttgtggagaagaacacacagcagttctcacaaagagtggaggtgtgtttacctttggcgctggttcctgtgggcaacttggacacgactccatgaatgatgaggttaaccctagaagagttctagagctgatgggtagtgaagtaactcaaattgcttgtggcagacaacataccctagccttcgtgccttcttctggactcatctatgcatttggttgtggagcaagaggtcaattaggaactgggcacacttgtaatgttaagtgcccatctcctgtcaagggttactgggctgcccacagtggccagctttcagcccgagctgatcgctttaaatatcatatcgttaagcagatcttctctggaggagaccagacttttgtactttgctccaaatacgagaattattctcctgctgttgacttcaggactatgaaccaagcacattataccagtttaataaatgatgaaaccatagcagtttggagacaaaaactctcagaacacaacaatgcaaatacaatcaatggtgttgttcagatattatcttctgcagcctgttggaatggaagttttcttgaaaaaaaaattgatgaacattttaaaacgagtcccaaaatccctgggattgacctgaactcaactagggtgttatttgagaagttaatgaactctcagcactccatgattctagaacagattttgaacagttttgaaagttgtctgattccccagttgtcaagctcaccaccagatgttgaagccatgagaatctatttaatactacctgagtttcccctactccaggattccaagtattatataacattgactattcccttggctatggccattcttcggctggatacaaaccccagcaaagtactagataactggtggtctcaggtatgcccgaaatatttcatgaagctggtaaacctctataaaggtgcagtcctttatctactgaggggaagaaagacattcttaattcccgtactgtttaacaattatatcacagcagctctcaaactcttggagaagttatataaggtaaatcttaaagtgaagcatgtggaatatgatacattttacattcctgagatttccaatctcgtggacattcaggaagactacctcatgtggttcttgcatcaagcagggatgaaggctagaccatcaataatacaggatactgtaacactttgttcctaccctttcatctttgatgcccaagccaagaccaaaatgttacagacagatgctgaactacagatgcaggtggcagtcaatggagccaacctgcagaatgtcttcatgcttctcaccctggagcctctgctggccagaagccccttcctggtccttcacgttcgcaggaacaaccttgttggagatgccctaagagagctgagcattcattctgatattgatttgaaaaagcctctcaaagtaatctttgatggtgaagaagcagtggatgccggtggtgttacaaaggaattttttcttttgctgttaaaagaacttttgaatcccatctatggaatgtttacctactatcaagattcaaatctcttgtggttttcagacacgtgttttgtagagcacaactggtttcacttgattggtataacctgtggactagctatctacaactccactgtggtcgatctccacttcccattggctctctacaagaagttactcaatgtaaagcctggcttggaagacttaaaggagttgtcacccactgaaggaaggagtctccaagagcttttagattaccccggggaggatgtggaggagactttctgcctcaacttcacgatctgccgagaaagctatggagtgattgaacagaagaagctgatacctgggggagataatgtaactgtgtgcaaggataacaggcaggaatttgtggatgcttatgtgaattatgtcttccaaatctcagttcatgaatggtacacagccttctctagtggcttcctaaaggtgtgtggtggcaaagtacttgagctcttccagccttcagaactgagggctatgatggtggggaacagcaactacaactgggaagaactggaagagactgccatctacaagggagattactcggccacacatcccactgtaaaactattttgggaaacatttcatgagtttccattggaaaagaagaagaagtttctcttgttcctgacaggcagcgatcggattcccatctacggcatggccagtctgcagattgtcatccagtccacagccagcggggaggagtacttgccggtggcccacacttgctacaaccttcttgacctccccaagtacagcagcaaagagattctgagtgcccggctgacccaggcccttgacaactatgaagggtttagtttggcctgaggcttctcagcttgtccagtatttcccttcgttcctcagtgtccacattgaggcctatacagaaaatcatggggagtgatttctatttttttattgtctaagtgggttgggacttttaaatactgagcctggttgatgtgtttctgggattgtatagcagtaaacaacctttttgaaaaattagaggttggggatggggtgaaaaattggcccttgtatgggaggtgtttttgtttttgttttaaaccaaactacccagtattccttgcacttgtgaatgtgttgcactctgctggatgaaatggcagtggatttttaaactttaatttcccaaatgtctctctcagccctgatgttttctcacagtgcttccttgtccttctcttaacttctcattcctctataagaatgatttagactgacctgtccttttttatctgcgcatgcgagaacatcaccttcctctgtacacttggaaatgcctctggcttgttgcagccctcctttaacccaaaggaggaaaggactgcttcagaaactcccaattccaaaaagctgagtctgggtccattattttggcagaactcctaagaatttatgggagcctatataaacatatcttgcttttaaaaagttcttgagggaatagcaactttcccatggctgtgcctatttcctagaccttttaaaagatgtgcagagcagcttagcattcgttgcagctgagcctaattttttcttgctcatccttgtccctttgacaataaggttaattgatagacccaccacctcttgcactctcgcttttggagcaagttgcattaactattttgagtctctatattgtccaagaaaagtagaaataataaatttactttccctttttctatcaccttatgtcctctaccattttctccttcctcccttcccttattttctccttttcgtaccctgtgtcctccctgattttcctttcgtttcttctttattttatcccattctctgttacttgactcagtgctcccttcctctcctctccttctagtggatgcatgcagcctttttttcaatttttatttaaattgcaaaatttttactcagattttttttcctcttccctaattgctaagatttaaggacgttctttattatgaaactttatcacattcgaaatgtttgtttacagtgggattttaggggggattgtgtttaaatcaaatatatgtattttaaaaataatgacatgctcaaccttcctcatcatggagtaagaaaattctacatgattaaagaatccatgtaagtctaattttaaattcctagtaactagagaaaagacttatttatataaaatgaagtatttatgaactgtgataaagcatcaaatcttgatgaaggattgtagatttttgctttttctttttgtttttaaaacttattccaattgctaaattggtagtttttcagtctttataaatacaggattaaaaatatatatacagttatatgaaatgtttattttctatgtgtgtgcatatagttcaatattatgcaataaatttggtgttttaacttaaaacta

SEQ ID NO: 298596 - DNA, 707 bp, Homo sapiens
  misc_feature (37)..(37): n is a, c, g, or t
  misc_feature (49)..(49): n is a, c, g, or t
  misc_feature (76)..(76): n is a, c, g, or t
  misc_feature (90)..(90): n is a, c, g, or t
ccttatggccacccccccaccttagacggtctttcantgaaaccacccncactccctaaacttcaacaggctccgnccccccccaaatcnacgtccaacccccaacccccccagagtagaattcactcaggggcaaggagcagatggcattaaggaagaatgaagtttttgaaggttgggatggacgaaaaggtgtttctcatggagagggatgctttagcaaaggctcaaacattggggcatatttaggcaagagccaagaacagtttgaagggaacatcagaggaaataggcaaataatagtaaataatggtaagtaagacttgggagaaagaaggtagatttggggctgaggaactagcctaacactggaactttagtagtagccaagtaggatttgtttcaatgttcagaacttgagggtgataagacctgagccgggtcttaagaaggaaaatgtggatggtctaaatctggaggtattgaggtgggaaggactgaagcagaaagacaggagctgagacagcagtgacagtggcagcagcagaactagagaagagtatctgaggagaggtagggggagtgagtggaggtggtaggagcctgcagggagaaggaggcactaaaggtggatcagagactggttcatttagtgattggtgattgttaggccatttaagcacaccaaaagtttgtgagacacagca

SEQ ID NO: 298597 - DNA, 289 bp, Homo sapiens
gaaacttccttattattgtgacgccgaaaacggagaaaccccgggtccggcgagaggggctgtgacagtcggagtcccaagctgcggttcggctgctgccgagaactgcaaggtgtggaatatttctggcttctagtccaatgccaagtgtgtgacctgtgagttaattctgcattttagttttggccctacatttatttaaagcctgaatttggggagtatctgcaaagcactgaaggttttggacattgtcttttcctgctgttgaaagagaccctcttcatatata

SEQ ID NO: 298598 - DNA, 4887 bp, Homo sapiens
gaaacttccttattattgtgacgccgaaaacggagaaaccccgggtccggcgagaggggctgtgacagtcggagtcccaagctgcggttcggctgctgccgagaactgcaaggtgtggaatatttctggcttctagtccaatgccaagtgtgtgacctgtggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcccacagtctggccctcagtgaccgaggccagctgttttcttggggtgcagggagtgatggtcagctaggactcatgactactgaggattctgtggcagtgcccaggttaatacaaaagctgaaccagcaaacaatattacaagtttcctgtggcaactggcattgcttggctcttgcggctgatggccagttcttcacctggggaaagaacagccatgggcagcttggcttagggaaggagttcccctcccaagccagcccacagagggtgaggtccctggaggggatcccactggctcaggtggctgccggaggggctcacagctttgccctgtctctctcaggagctgtttttggctgggggatgaataatgccgggcagctagggctcagtgatgaaaaagatcgagaatctccatgccatgtaaaactcttacgcacgcaaaaagttgtctatattagttgtggagaagaacacacagcagttctcacaaagagtggaggtgtgtttacctttggcgctggttcctgtgggcaacttggacacgactccatgaatgatgaggttaaccctagaagagttctagagctgatgggtagtgaagtaactcaaattgcttgtggcagacaacataccctagccttcgtgccttcttctggactcatctatgcatttggttgtggagcaagaggtcaattaggaactgggcacacttgtaatgttaagtgcccatctcctgtcaagggttactgggctgcccacagtggccagctttcagcccgagctgatcgctttaaatatcatatcgttaagcagatcttctctggaggagaccagacttttgtactttgctccaaatacgagaattattctcctgctgttgacttcaggactatgaaccaagcacattataccagtttaataaatgatgaaaccatagcagtttggagacaaaaactctcagaacacaacaatgcaaatacaatcaatggtgttgttcagatattatcttctgcagcctgttggaatggaagttttcttgaaaaaaaaattgatgaacattttaaaacgagtcccaaaatccctgggattgacctgaactcaactagggtgttatttgagaagttaatgaactctcagcactccatgattctagaacagattttgaacagttttgaaagttgtctgattccccagttgtcaagctcaccaccagatgttgaagccatgagaatctatttaatactacctgagtttcccctactccaggattccaagtattatataacattgactattcccttggctatggccattcttcggctggatacaaaccccagcaaagtactagataactggtggtctcaggtatgcccgaaatatttcatgaagctggtaaacctctataaaggtgcagtcctttatctactgaggggaagaaagacattcttaattcccgtactgtttaacaattatatcacagcagctctcaaactcttggagaagttatataaggtaaatcttaaagtgaagcatgtggaatatgatacattttacattcctgagatttccaatctcgtggacattcaggaagactacctcatgtggttcttgcatcaagcagggatgaaggctagaccatcaataatacaggatactgtaacactttgttcctaccctttcatctttgatgcccaagccaagagtggcagtcaatggagccaacctgcagaatgtcttcatgcttctcaccctggagcctctgctggccagaagccccttcctggtccttcacgttcgcaggaacaaccttgttggagatgccctaagagagctgagcattcattctgatattgatttgaaaaagcctctcaaagtaatctttgatggtgaagaagcagtggatgccggtggtgttacaaaggaattttttcttttgctgttaaaagaacttttgaatcccatctatggaatgtttacctactatcaagattcaaatctcttgtggttttcagacacgtgttttgtagagcacaactggtttcacttgattggtataacctgtggactagctatctacaactccactgtggtcgatctccacttcccattggctctctacaagaagttactcaatgtaaagcctggcttggaagacttaaaggagttgtcacccactgaaggaaggagtctccaagagcttttagattaccccggggaggatgtggaggagactttctgcctcaacttcacgatctgccgagaaagctatggagtgattgaacagaagaagctgatacctgggggagataatgtaactgtgtgcaaggataacaggcaggaatttgtggatgcttatgtgaattatgtcttccaaatctcagttcatgaatggtacacagccttctctagtggcttcctaaaggtgtgtggtggcaaagtacttgagctcttccagccttcagaactgagggctatgatggtggggaacagcaactacaactgggaagaactggaagagactgccatctacaagggagattactcggccacacatcccactgtaaaactattttgggaaacatttcatgagtttccattggaaaagaagaagaagtttctcttgttcctgacaggcagcgatcggattcccatctacggcatggccagtctgcagattgtcatccagtccacagccagcggggaggagtacttgccggtggcccacacttgctacaaccttcttgacctccccaagtacagcagcaaagagattctgagtgcccggctgacccaggcccttgacaactatgaagggtttagtttggcctgaggcttctcagcttgtccagtatttcccttcgttcctcagtgtccacattgaggcctatacagaaaatcatggggagtgatttctatttttttattgtctaagtgggttgggacttttaaatactgagcctggttgatgtgtttctgggattgtatagcagtaaacaacctttttgaaaaattagaggttggggatggggtgaaaaattggcccttgtatgggaggtgtttttgtttttgttttaaaccaaactacccagtattccttgcacttgtgaatgtgttgcactctgctggatgaaatggcagtggatttttaaactttaatttcccaaatgtctctctcagccctgatgttttctcacagtgcttccttgtccttctcttaacttctcattcctctataagaatgatttagactgacctgtccttttttatctgcgcatgcgagaacatcaccttcctctgtacacttggaaatgcctctggcttgttgcagccctcctttaacccaaaggaggaaaggactgcttcagaaactcccaattccaaaaagctgagtctgggtccattattttggcagaactcctaagaatttatgggagcctatataaacatatcttgcttttaaaaagttcttgagggaatagcaactttcccatggctgtgcctatttcctagaccttttaaaagatgtgcagagcagcttagcattcgttgcagctgagcctaattttttcttgctcatccttgtccctttgacaataaggttaattgatagacccaccacctcttgcactctcgcttttggagcaagttgcattaactattttgagtctctatattgtccaagaaaagtagaaataataaatttactttccctttttctatcaccttatgtcctctaccattttctccttcctcccttcccttattttctccttttcgtaccctgtgtcctccctgattttcctttcgtttcttctttattttatcccattctctgttacttgactcagtgctcccttcctctcctctccttctagtggatgcatgcagcctttttttcaatttttatttaaattgcaaaatttttactcagattttttttcctcttccctaattgctaagatttaaggacgttctttattatgaaactttatcacattcgaaatgtttgtttacagtgggattttaggggggattgtgtttaaatcaaatatatgtattttaaaaataatgacatgctcaaccttcctcatcatggagtaagaaaattctacatgattaaagaatccatgtaagtctaattttaaattcctagtaactagagaaaagacttatttatataaaatgaagtatttatgaactgtgataaagcatcaaatcttgatgaaggattgtagatttttgctttttctttttgtttttaaaacttattccaattgctaaattggtagtttttcagtctttataaatacaggattaaaaatatatatacagttatatgaaatgtttattttctatgtgtgtgcatatagttcaatattatgcaataaatttggtgttttaacttaaaacta

SEQ ID NO: 298599 - DNA, 4313 bp, Homo sapiens
tcccttcgattactcaccagacacgagagaagggagagaggcgtaactgcaaccctctcttaattttccaccgctacagatggccagttcttcacctggggaaagaacagccatgggcagcttggcttagggaaggagttcccctcccaagccagcccacagagggtgaggtccctggaggggatcccactggctcaggtggctgccggaggggctcacagctttgccctgtctctctcaggagctgtttttggctgggggatgaataatgccgggcagctagggctcagtgatgaaaaagatcgagaatctccatgccatgtaaaactcttacgcacgcaaaaagttgtctatattagttgtggagaagaacacacagcagttctcacaaagagtggaggtgtgtttacctttggcgctggttcctgtgggcaacttggacacgactccatgaatgatgaggttaaccctagaagagttctagagctgatgggtagtgaagtaactcaaattgcttgtggcagacaacataccctagccttcgtgccttcttctggactcatctatgcatttggttgtggagcaagaggtcaattaggaactgggcacacttgtaatgttaagtgcccatctcctgtcaagggttactgggctgcccacagtggccagctttcagcccgagctgatcgctttaaatatcatatcgttaagcagatcttctctggaggagaccagacttttgtactttgctccaaatacgagaattattctcctgctgttgacttcaggactatgaaccaagcacattataccagtttaataaatgatgaaaccatagcagtttggagacaaaaactctcagaacacaacaatgcaaatacaatcaatggtgttgttcagatattatcttctgcagcctgttggaatggaagttttcttgaaaaaaaaattgatgaacattttaaaacgagtcccaaaatccctgggattgacctgaactcaactagggtgttatttgagaagttaatgaactctcagcactccatgattctagaacagattttgaacagttttgaaagttgtctgattccccagttgtcaagctcaccaccagatgttgaagccatgagaatctatttaatactacctgagtttcccctactccaggattccaagtattatataacattgactattcccttggctatggccattcttcggctggatacaaaccccagcaaagtactagataactggtggtctcaggtatgcccgaaatatttcatgaagctggtaaacctctataaaggtgcagtcctttatctactgaggggaagaaagacattcttaattcccgtactgtttaacaattatatcacagcagctctcaaactcttggagaagttatataaggtaaatcttaaagtgaagcatgtggaatatgatacattttacattcctgagatttccaatctcgtggacattcaggaagactacctcatgtggttcttgcatcaagcagggatgaaggctagaccatcaataatacaggatactgtaacactttgttcctaccctttcatctttgatgcccaagccaagagtggcagtcaatggagccaacctgcagaatgtcttcatgcttctcaccctggagcctctgctggccagaagccccttcctggtccttcacgttcgcaggaacaaccttgttggagatgccctaagagagctgagcattcattctgatattgatttgaaaaagcctctcaaagtaatctttgatggtgaagaagcagtggatgccggtggtgttacaaaggaattttttcttttgctgttaaaagaacttttgaatcccatctatggaatgtttacctactatcaagattcaaatctcttgtggttttcagacacgtgttttgtagagcacaactggtttcacttgattggtataacctgtggactagctatctacaactccactgtggtcgatctccacttcccattggctctctacaagaagttactcaatgtaaagcctggcttggaagacttaaaggagttgtcacccactgaaggaaggagtctccaagagcttttagattaccccggggaggatgtggaggagactttctgcctcaacttcacgatctgccgagaaagctatggagtgattgaacagaagaagctgatacctgggggagataatgtaactgtgtgcaaggataacaggcaggaatttgtggatgcttatgtgaattatgtcttccaaatctcagttcatgaatggtacacagccttctctagtggcttcctaaaggtgtgtggtggcaaagtacttgagctcttccagccttcagaactgagggctatgatggtggggaacagcaactacaactgggaagaactggaagagactgccatctacaagggagattactcggccacacatcccactgtaaaactattttgggaaacatttcatgagtttccattggaaaagaagaagaagtttctcttgttcctgacaggcagcgatcggattcccatctacggcatggccagtctgcagattgtcatccagtccacagccagcggggaggagtacttgccggtggcccacacttgctacaaccttcttgacctccccaagtacagcagcaaagagattctgagtgcccggctgacccaggcccttgacaactatgaagggtttagtttggcctgaggcttctcagcttgtccagtatttcccttcgttcctcagtgtccacattgaggcctatacagaaaatcatggggagtgatttctatttttttattgtctaagtgggttgggacttttaaatactgagcctggttgatgtgtttctgggattgtatagcagtaaacaacctttttgaaaaattagaggttggggatggggtgaaaaattggcccttgtatgggaggtgtttttgtttttgttttaaaccaaactacccagtattccttgcacttgtgaatgtgttgcactctgctggatgaaatggcagtggatttttaaactttaatttcccaaatgtctctctcagccctgatgttttctcacagtgcttccttgtccttctcttaacttctcattcctctataagaatgatttagactgacctgtccttttttatctgcgcatgcgagaacatcaccttcctctgtacacttggaaatgcctctggcttgttgcagccctcctttaacccaaaggaggaaaggactgcttcagaaactcccaattccaaaaagctgagtctgggtccattattttggcagaactcctaagaatttatgggagcctatataaacatatcttgcttttaaaaagttcttgagggaatagcaactttcccatggctgtgcctatttcctagaccttttaaaagatgtgcagagcagcttagcattcgttgcagctgagcctaattttttcttgctcatccttgtccctttgacaataaggttaattgatagacccaccacctcttgcactctcgcttttggagcaagttgcattaactattttgagtctctatattgtccaagaaaagtagaaataataaatttactttccctttttctatcaccttatgtcctctaccattttctccttcctcccttcccttattttctccttttcgtaccctgtgtcctccctgattttcctttcgtttcttctttattttatcccattctctgttacttgactcagtgctcccttcctctcctctccttctagtggatgcatgcagcctttttttcaatttttatttaaattgcaaaatttttactcagattttttttcctcttccctaattgctaagatttaaggacgttctttattatgaaactttatcacattcgaaatgtttgtttacagtgggattttaggggggattgtgtttaaatcaaatatatgtattttaaaaataatgacatgctcaaccttcctcatcatggagtaagaaaattctacatgattaaagaatccatgtaagtctaattttaaattcctagtaactagagaaaagacttatttatataaaatgaagtatttatgaactgtgataaagcatcaaatcttgatgaaggattgtagatttttgctttttctttttgtttttaaaacttattccaattgctaaattggtagtttttcagtctttataaatacaggattaaaaatatatatacagttatatgaaatgtttattttctatgtgtgtgcatatagttcaatattatgcaataaatttggtgttttaacttaaaacta

SEQ ID NO: 298600 - DNA, 4826 bp, Homo sapiens
gaaacttccttattattgtgacgccgaaaacggagaaaccccgggtccggcgagaggggctgtgacagtcggagtcccaagctgcggttcggctgctgccgagaactgcaaggtgtggaatatttctggcttctagtccaatgccaagtgtgtgacctgtggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcccacagtctggccctcagtgaccgaggccagctgttttcttggggtgcagggagtgatggtcagctaggactcatgactactgaggattctgtggcagtgcccaggttaatacaaaagctgaaccagcaaacaatattacaagtttcctgtggcaactggcattgcttggctcttgcggctgatggccagttcttcacctggggaaagaacagccatgggcagcttggcttagggaaggagttcccctcccaagccagcccacagagggtgaggtccctggaggggatcccactggctcaggtggctgccggaggggctcacagctttgccctgtctctctcaggagctgtttttggctgggggatgaataatgccgggcagctagggctcagtgatgaaaaagatcgagaatctccatgccatgtaaaactcttacgcacgcaaaaagttgtctatattagttgtggagaagaacacacagcagttctcacaaagagtggaggtgtgtttacctttggcgctggttcctgtgggcaacttggacacgactccatgaatgatgaggttaaccctagaagagttctagagctgatgggtagtgaagtaactcaaattgcttgtggcagacaacataccctagccttcgtgccttcttctggactcatctatgcatttggttgtggagcaagaggtcaattaggaactgggcacacttgtaatgttaagtgcccatctcctgtcaagggttactgggctgcccacagtggccagctttcagcccgagctgatcgctttaaatatcatatcgttaagcagatcttctctggaggagaccagacttttgtactttgctccaaatacgagaattattctcctgctgttgacttcaggactatgaaccaagcacattataccagtttaataaatgatgaaaccatagcagtttggagacaaaaactctcagaacacaacaatgcaaatacaatcaatggtgttgttcagatattatcttctgcagcctgttggaatggaagttttcttgaaaaaaaaattgatgaacattttaaaacgagtcccaaaatccctgggattgacctgaactcaactagggtgttatttgagaagttaatgaactctcagcactccatgattctagaacagattttgaacagttttgaaagttgtctgattccccagttgtcaagctcaccaccagatgttgaagccatgagaatctatttaatactacctgagtttcccctactccaggattccaagtattatataacattgactattcccttggctatggccattcttcggctggatacaaaccccagcaaagtactagataactggtggtctcaggtatgcccgaaatatttcatgaagctggtaaacctctataaaggtgcagtcctttatctactgaggggaagaaagacattcttaattcccgtactgtttaacaattatatcacagcagctctcaaactcttggagaagttatataaggtaaatcttaaagtgaagcatgtggaatatgatacattttacattcctgagatttccaatctcgtggacattcaggaagactacctcatgtggttcttgcatcaagcagggatgaaggctagaccatcaataatacaggatactgtaacactttgttcctaccctttcatctttgatgcccaagccaagagtggcagtcaatggagccaacctgcagaatgtcttcatgcttctcaccctggagcctctgctggccagaagccccttcctggtccttcacgttcgcaggaacaaccttgttggagatgccctaagagagctgagcattcattctgatattgatttgaaaaagcctctcaaagtaatctttgatggtgaagaagcagtggatgccggtggtgttacaaaggaattttttcttttgctgttaaaagaacttttgaatcccatctatggaatgtttacctactatcaagattcaaatctcttgtggttttcagacacgtgttttgtagagcacaactggtttcacttgattggtataacctgtggactagctatctacaactccactgtggtcgatctccacttcccattggctctctacaagaagttactcaatgtaaagcctggcttggaagacttaaaggagttgtcacccactgaaggaaggagtctccaagagcttttagattaccccggggaggatgtggaggagactttctgcctcaacttcacgatctgccgagaaagctatggagtgattgaacagaagaagctgatacctgggggagataatgtaactgtgtgcaaggataacaggcaggaatttgtggatgcttatgtgaattatgtcttccaaatctcagttcatgaatggtacacagccttctctagtggcttcctaaaggtgtgtggtggcaaagtacttgagctcttccagccttcagaactgagggctatgatggtggggaacagcaactacaactgggaagaactggaagagactgccatctacaagggagattactcggccacacatcccactgtaaaactattttgggaaacatttcatgagtttccattggaaaagaagaagaagtttctcttgttcctgacaggcagcgatcggattcccatctacggcatggccagtctgcagattgtcatccagtccacagccagcggggaggagtacttgccggtggcccacacttgctacaaccttcttgacctccccaagtacagcagcaaagagattctgagtgcccggctgacccaggcccttgacaactatgaagggtttagtttggcctgaggcttctcagcttgtccagtatttcccttcgttcctcagtgtccacattgaggcctatacagaaaatcatggggagtgatttctatttttttattgtctaagtgggttgggacttttaaatactgagcctggttgatgtgtttctgggattgtatagcagtaaacaacctttttgaaaaattagaggttggggatggggtgaaaaattggcccttgtatgggaggtgtttttgtttttgttttaaaccaaactacccagtattccttgcacttgtgaatgtgttgcactctgctggatgaaatggcagtggatttttaaactttaatttcccaaatgtctctctcagccctgatgttttctcacagtgcttccttgtccttctcttaacttctcattcctctataagaatgatttagactgacctgtccttttttatctgcgcatgcgagaacatcaccttcctctgtacacttggaaatgcctctggcttgttgcagccctcctttaacccaaaggaggaaaggactgcttcagaaactcccaattccaaaaagctgagtctgggtccattattttggcagaactcctaagaatttatgggagcctatataaacatatcttgcttttaaaaagttcttgagggaatagcaactttcccatggctgtgcctatttcctagaccttttaaaagatgtgcagagcagcttagcattcgttgcagctgagcctaattttttcttgctcatccttgtccctttgacaataaggttaattgatagacccaccacctcttgcactctcgcttttggagcaagttgcattaactattttgagtctctatattgtccaagatccttcctcccttcccttattttctccttttcgtaccctgtgtcctccctgattttcctttcgtttcttctttattttatcccattctctgttacttgactcagtgctcccttcctctcctctccttctagtggatgcatgcagcctttttttcaatttttatttaaattgcaaaatttttactcagattttttttcctcttccctaattgctaagatttaaggacgttctttattatgaaactttatcacattcgaaatgtttgtttacagtgggattttaggggggattgtgtttaaatcaaatatatgtattttaaaaataatgacatgctcaaccttcctcatcatggagtaagaaaattctacatgattaaagaatccatgtaagtctaattttaaattcctagtaactagagaaaagacttatttatataaaatgaagtatttatgaactgtgataaagcatcaaatcttgatgaaggattgtagatttttgctttttctttttgtttttaaaacttattccaattgctaaattggtagtttttcagtctttataaatacaggattaaaaatatatatacagttatatgaaatgtttattttctatgtgtgtgcatatagttcaatattatgcaataaatttggtgttttaacttaaaacta

SEQ ID NO: 298601 - DNA, 3581 bp, Homo sapiens
ttctttttactgttacatttaattctccagaattattctcctgctgttgacttcaggactatgaaccaagcacattataccagtttaataaatgatgaaaccatagcagtttggagacaaaaactctcagaacacaacaatgcaaatacaatcaatggtgttgttcagatattatcttctgcagcctgttggaatggaagttttcttgaaaaaaaaattgatgaacattttaaaacgagtcccaaaatccctgggattgacctgaactcaactagggtgttatttgagaagttaatgaactctcagcactccatgattctagaacagattttgaacagttttgaaagttgtctgattccccagttgtcaagctcaccaccagatgttgaagccatgagaatctatttaatactacctgagtttcccctactccaggattccaagtattatataacattgactattcccttggctatggccattcttcggctggatacaaaccccagcaaagtactagataactggtggtctcaggtatgcccgaaatatttcatgaagctggtaaacctctataaaggtgcagtcctttatctactgaggggaagaaagacattcttaattcccgtactgtttaacaattatatcacagcagctctcaaactcttggagaagttatataaggtaaatcttaaagtgaagcatgtggaatatgatacattttacattcctgagatttccaatctcgtggacattcaggaagactacctcatgtggttcttgcatcaagcagggatgaaggctagaccatcaataatacaggatactgtaacactttgttcctaccctttcatctttgatgcccaagccaagagtggcagtcaatggagccaacctgcagaatgtcttcatgcttctcaccctggagcctctgctggccagaagccccttcctggtccttcacgttcgcaggaacaaccttgttggagatgccctaagagagctgagcattcattctgatattgatttgaaaaagcctctcaaagtaatctttgatggtgaagaagcagtggatgccggtggtgttacaaaggaattttttcttttgctgttaaaagaacttttgaatcccatctatggaatgtttacctactatcaagattcaaatctcttgtggttttcagacacgtgttttgtagagcacaactggtttcacttgattggtataacctgtggactagctatctacaactccactgtggtcgatctccacttcccattggctctctacaagaagttactcaatgtaaagcctggcttggaagacttaaaggagttgtcacccactgaaggaaggagtctccaagagcttttagattaccccggggaggatgtggaggagactttctgcctcaacttcacgatctgccgagaaagctatggagtgattgaacagaagaagctgatacctgggggagataatgtaactgtgtgcaaggataacaggcaggaatttgtggatgcttatgtgaattatgtcttccaaatctcagttcatgaatggtacacagccttctctagtggcttcctaaaggtgtgtggtggcaaagtacttgagctcttccagccttcagaactgagggctatgatggtggggaacagcaactacaactgggaagaactggaagagactgccatctacaagggagattactcggccacacatcccactgtaaaactattttgggaaacatttcatgagtttccattggaaaagaagaagaagtttctcttgttcctgacaggcagcgatcggattcccatctacggcatggccagtctgcagattgtcatccagtccacagccagcggggaggagtacttgccggtggcccacacttgctacaaccttcttgacctccccaagtacagcagcaaagagattctgagtgcccggctgacccaggcccttgacaactatgaagggtttagtttggcctgaggcttctcagcttgtccagtatttcccttcgttcctcagtgtccacattgaggcctatacagaaaatcatggggagtgatttctatttttttattgtctaagtgggttgggacttttaaatactgagcctggttgatgtgtttctgggattgtatagcagtaaacaacctttttgaaaaattagaggttggggatggggtgaaaaattggcccttgtatgggaggtgtttttgtttttgttttaaaccaaactacccagtattccttgcacttgtgaatgtgttgcactctgctggatgaaatggcagtggatttttaaactttaatttcccaaatgtctctctcagccctgatgttttctcacagtgcttccttgtccttctcttaacttctcattcctctataagaatgatttagactgacctgtccttttttatctgcgcatgcgagaacatcaccttcctctgtacacttggaaatgcctctggcttgttgcagccctcctttaacccaaaggaggaaaggactgcttcagaaactcccaattccaaaaagctgagtctgggtccattattttggcagaactcctaagaatttatgggagcctatataaacatatcttgcttttaaaaagttcttgagggaatagcaactttcccatggctgtgcctatttcctagaccttttaaaagatgtgcagagcagcttagcattcgttgcagctgagcctaattttttcttgctcatccttgtccctttgacaataaggttaattgatagacccaccacctcttgcactctcgcttttggagcaagttgcattaactattttgagtctctatattgtccaagaaaagtagaaataataaatttactttccctttttctatcaccttatgtcctctaccattttctccttcctcccttcccttattttctccttttcgtaccctgtgtcctccctgattttcctttcgtttcttctttattttatcccattctctgttacttgactcagtgctcccttcctctcctctccttctagtggatgcatgcagcctttttttcaatttttatttaaattgcaaaatttttactcagattttttttcctcttccctaattgctaagatttaaggacgttctttattatgaaactttatcacattcgaaatgtttgtttacagtgggattttaggggggattgtgtttaaatcaaatatatgtattttaaaaataatgacatgctcaaccttcctcatcatggagtaagaaaattctacatgattaaagaatccatgtaagtctaattttaaattcctagtaactagagaaaagacttatttatataaaatgaagtatttatgaactgtgataaagcatcaaatcttgatgaaggattgtagatttttgctttttctttttgtttttaaaacttattccaattgctaaattggtagtttttcagtctttataaatacaggattaaaaatatatatacagttatatgaaatgtttattttctatgtgtgtgcatatagttcaatattatgcaataaatttggtgttttaacttaaaacta

SEQ ID NO: 298602 - DNA, 5353 bp, Homo sapiens
  misc_feature (5170)..(5170): n is a, c, g, or t
gaaacttccttattattgtgacgccgaaaacggagaaaccccgggtccggcgagaggggctgtgacagtcggagtcccaagctgcggttcggctgctgccgagaactgcaaggtgtggaatatttctggcttctagtccaatgccaagtgtgtgacctgtggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcccacagtctggccctcagtgaccgaggccagctgttttcttggggtgcagggagtgatggtcagctaggactcatgactactgaggattctgtggcagtgcccaggttaatacaaaagctgaaccagcaaacaatattacaagtttcctgtggcaactggcattgcttggctcttgcggctgatggccagttcttcacctggggaaagaacagccatgggcagcttggcttagggaaggagttcccctcccaagccagcccacagagggtgaggtccctggaggggatcccactggctcaggtggctgccggaggggctcacagctttgccctgtctctctcaggagctgtttttggctgggggatgaataatgccgggcagctagggctcagtgatgaaaaagatcgagaatctccatgccatgtaaaactcttacgcacgcaaaaagttgtctatattagttgtggagaagaacacacagcagttctcacaaagagtggaggtgtgtttacctttggcgctggttcctgtgggcaacttggacacgactccatgaatgatgaggttaaccctagaagagttctagagctgatgggtagtgaagtaactcaaattgcttgtggcagacaacataccctagccttcgtgccttcttctggactcatctatgcatttggttgtggagcaagaggtcaattaggaactgggcacacttgtaatgttaagtgcccatctcctgtcaagggttactgggctgcccacagtggccagctttcagcccgagctgatcgctttaaatatcatatcgttaagcagatcttctctggaggagaccagacttttgtactttgctccaaatacgagaattattctcctgctgttgacttcaggactatgaaccaagcacattataccagtttaataaatgatgaaaccatagcagtttggagacaaaaactctcagaacacaacaatgcaaatacaatcaatggtgttgttcagatattatcttctgcagcctgttggaatggaagttttcttgaaaaaaaaattgatgaacattttaaaacgagtcccaaaatccctgggattgacctgaactcaactagggtgttatttgagaagttaatgaactctcagcactccatgattctagaacagattttgaacagttttgaaagttgtctgattccccagttgtcaagctcaccaccagatgttgaagccatgagaatctatttaatactacctgagtttcccctactccaggattccaagtattatataacattgactattcccttggctatggccattcttcggctggatacaaaccccagcaaagtactagataactggtggtctcaggtatgcccgaaatatttcatgaagctggtaaacctctataaaggtgcagtcctttatctactgaggggaagaaagacattcttaattcccgtactgtttaacaattatatcacagcagctctcaaactcttggagaagttatataaggtaaatcttaaagtgaagcatgtggaatatgatacattttacattcctgagatttccaatctcgtggacattcaggaagactacctcatgtggttcttgcatcaagcagggatgaaggctagaccatcaataatacaggatactgtaacactttgttcctaccctttcatctttgatgcccaagccaagagtggcagtcaatggagccaacctgcagaatgtcttcatgcttctcaccctggagcctctgctggccagaagccccttcctggtccttcacgttcgcaggaacaaccttgttggagatgccctaagagagctgagcattcattctgatattgatttgaaaaagcctctcaaagtaatctttgatggtgaagaagcagtggatgccggtggtgttacaaaggaattttttcttttgctgttaaaagaacttttgaatcccatctatggaatgtttacctactatcaagattcaaatctcttgtggttttcagacacgtgttttgtagagcacaactggtttcacttgattggtataacctgtggactagctatctacaactccactgtggtcgatctccacttcccattggctctctacaagaagttactcaatgtaaagcctggcttggaagacttaaaggagttgtcacccactgaaggaaggagtctccaagagcttttagattaccccggggaggatgtggaggagactttctgcctcaacttcacgatctgccgagaaagctatggagtgattgaacagaagaagctgatacctgggggagataatgtaactgtgtgcaaggataacaggcaggaatttgtggatgcttatgtgaattatgtcttccaaatctcagttcatgaatggtacacagccttctctagtggcttcctaaaggtgtgtggtggcaaagtacttgagctcttccagccttcagaactgagggctatgatggtggggaacagcaactacaactgggaagaactggaagagactgccatctacaagggagattactcggccacacatcccactgtaaaactattttgggaaacatttcatgagtttccattggaaaagaagaagaagtttctcttgttcctgacaggcagcgatcggattcccatctacggcatggccagtctgcagattgtcatccagtccacagccagcggggaggagtacttgccggtggcccacacttgctacaaccttcttgacctccccaagtacagcagcaaagagattctgagtgcccggctgacccaggcccttgacaactatgaagggtttagtttggcctgaggcttctcagcttgtccagtatttcccttcgttcctcagtgtccacattgaggcctatacagaaaatcatggggagtgatttctatttttttattgtctaagtgggttgggacttttaaatactgagcctggttgatgtgtttctgggattgtatagcagtaaacaacctttttgaaaaattagaggttggggatggggtgaaaaattggcccttgtatgggaggtgtttttgtttttgttttaaaccaaactacccagtattccttgcacttgtgaatgtgttgcactctgctggatgaaatggcagtggatttttaaactttaatttcccaaatgtctctctcagccctgatgttttctcacagtgcttccttgtccttctcttaacttctcattcctctataagaatgatttagactgacctgtccttttttatctgcgcatgcgagaacatcaccttcctctgtacacttggaaatgcctctggcttgttgcagccctcctttaacccaaaggaggaaaggactgcttcagaaactcccaattccaaaaagctgagtctgggtccattattttggcagaactcctaagaatttatgggagcctatataaacatatcttgcttttaaaaagttcttgagggaatagcaactttcccatggctgtgcctatttcctagaccttttaaaagatgtgcagagcagcttagcattcgttgcagctgagcctaattttttcttgctcatccttgtccctttgacaataaggttaattgatagacccaccacctcttgcactctcgcttttggagcaagttgcattaactattttgagtctctatattgtccaagaaaagtagaaataataaatttactttccctttttctatcaccttatgtcctctaccattttctccttcctcccttcccttattttctccttttcgtaccctgtgtcctccctgattttcctttcgtttcttctttattttatcccattctctgttacttgactcagtgctcccttcctctcctctccttctagtggatgcatgcagcctttttttcaatttttatttaaattgcaaaatttttactcagattttttttcctcttccctaattgctaagatttaaggacgttctttattatgaaactttatcacattcgaaatgtttgtttacagtgggattttaggggggattgtgtttaaatcaaatatatgtattttaaaaataatgacatgctcaaccttcctcatcatggagtaagaaaattctacatgattaaagaatccatgtaagtctaattttaaattcctagtaactagagaaaagacttatttatataaaatgaagtatttatgaactgtgataaagcatcaaatcttgatgaaggattgtagatttttgctttttctttttgtttttaaaacttattccaattgctaaattggtagtttttcagtctttataaatacaggattaaaaatatatatacagttatatgaaatgtttattttctatgtgtgtgcatatagttcaatattatgcaataaatttggtgttttaacttaaaactaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaataaactaaaaaactaaaaataaaataaattaaataacaaatatatacaaaaaaaaaaattttccccctctttctccaacactattttttccctcacacattttaatttactcccctactactcctttatattctcataatccccaaatcttttattctttaatcatttcnccctcttttctcatataattcctcctctttaaacatctttttctctacccaatattacatcctttctctactaacacaaccctcttttactaacttactcaaatacatctaatctctctcataacatctctcattctcctttatacttctctctctattctcctctcatcatcttcttcttct

SEQ ID NO: 298603 - DNA, 4013 bp, Homo sapiens
gaaacttccttattattgtgacgccgaaaacggagaaaccccgggtccggcgagaggggctgtgacagtcggagtcccaagctgcggttcggctgctgccgagaactgcaaggtgtggaatatttctggcttctagtccaatgccaagtgtgtgacctgtggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcccacagtctggccctcagtgaccgaggccagctgttttcttggggtgcagggagtgatggtcagctaggactcatgactactgaggattctgtggcagtgcccaggttaatacaaaagctgaaccagcaaacaatattacaagtttcctgtggcaactggcattgcttggctcttgcggctgatggccagttcttcacctggggaaagaacagccatgggcagcttggcttagggaaggagttcccctcccaagccagcccacagagggtgaggtccctggaggggatcccactggctcaggtggctgccggaggggctcacagctttgccctgtctctctcaggagctgtttttggctgggggatgaataatgccgggcagctagggctcagtgatgaaaaagatcgagaatctccatgccatgtaaaactcttacgcacgcaaaaagttgtctatattagttgtggagaagaacacacagcagttctcacaaagagtggaggtgtgtttacctttggcgctggttcctgtgggcaacttggacacgactccatgaatgatgaggttaaccctagaagagttctagagctgatgggtagtgaagtaactcaaattgcttgtggcagacaacataccctagccttcgtgccttcttctggactcatctatgcatttggttgtggagcaagaggtcaattaggaactgggcacacttgtaatgttaagtgcccatctcctgtcaagggttactgggctgcccacagtggccagctttcagcccgagctgatcgctttaaatatcatatcgttaagcagatcttctctggaggagaccagacttttgtactttgctccaaatacgagaattattctcctgctgttgacttcaggactatgaaccaagcacattataccagtttaataaatgatgaaaccatagcagtttggagacaaaaactctcagaacacaacaatgcaaatacaatcaatggtgttgttcagatattatcttctgcagcctgttggaatggaagttttcttgaaaaaaaaattgatgaacattttaaaacgagtcccaaaatccctgggattgacctgaactcaactagggtgttatttgagaagttaatgaactctcagcactccatgattctagaacagattttgaacagttttgaaagttgtctgattccccagttgtcaagctcaccaccagatgttgaagccatgagaatctatttaatactacctgagtttcccctactccaggattccaagtattatataacattgactattcccttggctatggccattcttcggctggatacaaaccccagcaaagtactagataactggtggtctcaggtatgcccgaaatatttcatgaagctggtaaacctctataaaggtgcagtcctttatctactgaggggaagaaagacattcttaattcccgtactgtttaacaattatatcacagcagctctcaaactcttggagaagttatataaggtaaatcttaaagtgaagcatgtggaatatgatacattttacattcctgagatttccaatctcgtggacattcaggaagactacctcatgtggttcttgcatcaagcagggatgaaggctagaccatcaataatacaggatactgtaacactttgttcctaccctttcatctttgatgcccaagccaagagtggcagtcaatggagccaacctgcagaatgtcttcatgcttctcaccctggagcctctgctggccagaagccccttcctggtccttcacgttcgcaggaacaaccttgttggagatgccctaagagagctgagcattcattctgatattgatttgaaaaagcctctcaaagtaatctttgatggtgaagaagcagtggatgccggtggtgttacaaaggaattttttcttttgctgttaaaagaacttttgaatcccatctatggaatgtttacctactatcaagattcaaatctcttgtggttttcagacacgtgttttgtagagcacaactggtttcacttgattggtataacctgtggactagctatctacaactccactgtggtcgatctccacttcccattggctctctacaagaagttactcaatgtaaagcctggcttggaagacttaaaggagttgtcacccactgaaggaaggagtctccaagagcttttagattaccccggggaggatgtggaggagactttctgcctcaacttcacgatctgccgagaaagctatggagtgattgaacagaagaagctgatacctgggggagataatgtaactgtgtgcaaggataacaggcaggaatttgtggatgcttatgtgaattatgtcttccaaatctcagttcatgaatggtacacagccttctctagtggcttcctaaaggtgtgtggtggcaaagtacttgagctcttccagccttcagaactgagggctatgatggtggggaacagcaactacaactgggaagaactggaagagactgccatctacaagggagattactcggccacacatcccactgtaaaactattttgggaaacatttcatgagtttccattggaaaagaagaagaagtttctcttgttcctgacaggcagcgatcggattcccatctacggcatggccagtctgcagattgtcatccagtccacagccagcggggaggagtacttgccggtggcccacacttgctacaaccttcttgacctccccaagtacagcagcaaagagattctgagtgcccggctgacccaggcccttgacaactatgaagggtttagtttggcctgaggcttctcagcttgtccagtatttcccttcgttcctcagtgtccacattgaggcctatacagaaaatcatggggagtgatttctatttttttattgtctaagtgggttgggacttttaaatactgagcctggttgatgtgtttctgggattgtatagcagtaaacaacctttttgaaaaattagaggttggggatggggtgaaaaattggcccttgtatgggaggtgtttttgtttttgttttaaaccaaactacccagtattccttgcacttgtgaatgtgttgcactctgctggatgaaatggcagtggatttttaaactttaatttcccaaatgtctctctcagccctgatgttttctcacagtgcttccttgtccttctcttaacttctcattcctctataagaatgatttagactgacctgtccttttttatctgcgcatgcgagaacatcaccttcctctgtacacttggaaatgcctctggcttgttgcagccctcctttaacccaaaggaggaaaggactgcttcagaaactcccaattccaaaaagctgagtctgggtccattattttggcagaactcctaagaatttatgggagcctatataaacatatcttgcttttaaaaagttcttgagggaatagcaactttcccatggctgtgcctatttcctagaccttttgctcatccttgtccctttgac

SEQ ID NO: 298604 - DNA, 3327 bp, Homo sapiens
gaaacttccttattattgtgacgccgaaaacggagaaaccccgggtccggcgagaggggctgtgacagtcggagtcccaagctgcggttcggctgctgccgagaactgcaaggtgtggaatatttctggcttctagtccaatgccaagtgtgtgacctgtggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcccacagtctggccctcagtgaccgaggccagctgttttcttggggtgcagggagtgatggtcagctaggactcatgactactgaggattctgtggcagtgcccaggttaatacaaaagctgaaccagcaaacaatattacaagtttcctgtggcaactggcattgcttggctcttgcggctgatggccagttcttcacctggggaaagaacagccatgggcagcttggcttagggaaggagttcccctcccaagccagcccacagagggtgaggtccctggaggggatcccactggctcaggtggctgccggaggggctcacagctttgccctgtctctctcaggagctgtttttggctgggggatgaataatgccgggcagctagggctcagtgatgaaaaagatcgagaatctccatgccatgtaaaactcttacgcacgcaaaaagttgtctatattagttgtggagaagaacacacagcagttctcacaaagagtggaggtgtgtttacctttggcgctggttcctgtgggcaacttggacacgactccatgaatgatgaggttaaccctagaagagttctagagctgatgggtagtgaagtaactcaaattgcttgtggcagacaacataccctagccttcgtgccttcttctggactcatctatgcatttggttgtggagcaagaggtcaattaggaactgggcacacttgtaatgttaagtgcccatctcctgtcaagggttactgggctgcccacagtggccagctttcagcccgagctgatcgctttaaatatcatatcgttaagcagatcttctctggaggagaccagacttttgtactttgctccaaatacgagaattattctcctgctgttgacttcaggactatgaaccaagcacattataccagtttaataaatgatgaaaccatagcagtttggagacaaaaactctcagaacacaacaatgcaaatacaatcaatggtgttgttcagatattatcttctgcagcctgttggaatggaagttttcttgaaaaaaaaattgatgaacattttaaaacgagtcccaaaatccctgggattgacctgaactcaactagggtgttatttgagaagttaatgaactctcagcactccatgattctagaacagattttgaacagttttgaaagttgtctgattccccagttgtcaagctcaccaccagatgttgaagccatgagaatctatttaatactacctgagtttcccctactccaggattccaagtattatataacattgactattcccttggctatggccattcttcggctggatacaaaccccagcaaagtactagataactggtggtctcaggtatgcccgaaatatttcatgaagctggtaaacctctataaaggtgcagtcctttatctactgaggggaagaaagacattcttaattcccgtactgtttaacaattatatcacagcagctctcaaactcttggagaagttatataaggtaaatcttaaagtgaagcatgtggaatatgatacattttacattcctgagatttccaatctcgtggacattcaggaagactacctcatgtggttcttgcatcaagcagggatgaaggctagaccatcaataatacaggatactgtaacactttgttcctaccctttcatctttgatgcccaagccaagagtggcagtcaatggagccaacctgcagaatgtcttcatgcttctcaccctggagcctctgctggccagaagccccttcctggtccttcacgttcgcaggaacaaccttgttggagatgccctaagagagctgagcattcattctgatattgatttgaaaaagcctctcaaagtaatctttgatggtgaagaagcagtggatgccggtggtgttacaaaggaattttttcttttgctgttaaaagaacttttgaatcccatctatggaatgtttacctactatcaagattcaaatctcttgtggttttcagacacgtgttttgtagagcacaactggtttcacttgattggtataacctgtggactagctatctacaactccactgtggtcgatctccacttcccattggctctctacaagaagttactcaatgtaaagcctggcttggaagacttaaaggagttgtcacccactgaaggaagtccttcctcccttcccttattttctccttttcgtaccctgtgtcctccctgattttcctttcgtttcttctttattttatcccattctctgttacttgactcagtgctcccttcctctcctctccttctagtggatgcatgcagcctttttttcaatttttatttaaattgcaaaatttttactcagattttttttcctcttccctaattgctaagatttaaggacgttctttattatgaaactttatcacattcgaaatgtttgtttacagtgggattttaggggggattgtgtttaaatcaaatatatgtattttaaaaataatgacatgctcaaccttcctcatcatggagtaagaaaattctacatgattaaagaatccatgtaagtctaattttaaattcctagtaactagagaaaagacttatttatataaaatgaagtatttatgaactgtgataaagcatcaaatcttgatgaaggattgtagatttttgctttttctttttgtttttaaaacttattccaattgctaaattggtagtttttcagtctttataaatacaggattaaaaatatatatacagttatatgaaatgtttattttctatgtgtgtgcatatagttcaatattatgcaataaatttggtgttttaacttaaaacta

SEQ ID NO: 298605 - DNA, 747 bp, Homo sapiens
ccaatcaacatccaaccccaatcaacatccacctttttaatctggcaaaacaatacattttacttgctttaccaatttatccttcctcccttcccttattttctccttttcgtaccctgtgtcctccctgattttcctttcgtttcttctttattttatcccattctctgttacttgactcagtgctcccttcctctcctctccttctagtggatgcatgcagcctttttttcaatttttatttaaattgcaaaatttttactcagattttttttcctcttccctaattgctaagatttaaggacgttctttattatgaaactttatcacattcgaaatgtttgtttacagtgggattttaggggggattgtgtttaaatcaaatatatgtattttaaaaataatgacatgctcaaccttcctcatcatggagtaagaaaattctacatgattaaagaatccatgtaagtctaattttaaattcctagtaactagagaaaagacttatttatataaaatgaagtatttatgaactgtgataaagcatcaaatcttgatgaaggattgtagatttttgctttttctttttgtttttaaaacttattccaattgctaaattggtagtttttcagtctttataaatacaggattaaaaatatatatacagttatatgaaatgtttattttctatgtgtgtgcatatagttcaatattatgcaataaatttggtgttttaacttaaaacta

SEQ ID NO: 298606 - DNA, 1909 bp, Homo sapiens
gaaacttccttattattgtgacgccgaaaacggagaaaccccgggtccggcgagaggggctgtgacagtcggagtcccaagctgcggttcggctgctgccgagaactgcaaggtgtggaatatttctggcttctagtccaatgccaagtgtgtgacctgtggctacatgattccctgaaagataagaacaatgttatgttggggatattggtctctgggccaacctggtatcagcaccaacctgcagggaattgtggctgagccccaggtgtgtgggttcatatctgacagaagtgtcaaggaagtggcctgtgggggaaaccactctgtgttcctgctggaagatggggaagtttacacatgtggtttgaacaccaaggggcaactgggccatgagagggaaggaaacaagccagaacaaattggagctctggcagatcagcatatcattcatgtggcatgtggcgagtcccacagtctggccctcagtgaccgaggccagctgttttcttggggtgcagggagtgatggtcagctaggactcatgactactgaggattctgtggcagtgcccaggttaatacaaaagctgaaccagcaaacaatattacaagtttcctgtggcaactggcattgcttggctcttgcggctgatggccagttcttcacctggggaaagaacagccatgggcagcttggcttagggaaggagttcccctcccaagccagcccacagagggtgaggtccctggaggggatcccactggctcaggtggctgccggaggggctcacagctttgccctgtctctctcaggagctgtttttggctgggggatgaataatgccgggcagctagggctcagtgatgaaaaagatcgagaatctccatgccatgtaaaactcttacgcacgcaaaaagttgtctatattagttgtggagaagaacacacagcagttctcacaaagagtggaggtgtgtttacctttggcgctggttcctgtgggcaacttggacacgactccatgaatgatgaggttaaccctagaagagttctagagctgatgggtagtgaagtaactcaaattgcttgtggcagacaacataccctagccttcgtgccttcttctggactcatctatgcatttggttgtggagcaagaggtcaattaggaactgggcacacttgtaatgttaagtgcccatctcctgtcaagggttactgggctgcccacagtggccagctttcagcccgagctgatcgctttaaatatcatatcgttaagcagatcttctctggaggagaccagacttttgtactttgctccaaatacgagaattattctcctgctgttgacttcaggactatgaaccaagcacattataccagtttaataaatgatgaaaccatagcagtttggagacaaaaactctcagaacacaacaatgcaaatacaatcaagtatgtggctgcttgtcttcatttttttttccacaaagtatgttacaactttttagcttagtgtgattttccgtacttgcatattgatactgtgaatgtaaatggggttttacattatagggaatcgtgggttatttttggttactatttcagggttgatctccttagccccaaatagcataatggatggatccccaattctcacacacagtatatgcctcaacctgccttgtttattgtatgatcttaaaaatcctgactgatgaaggcctgagttggtgattctgctaagagagcttagcgttatggttaactcccatgggttttagtgtatgcatgttccaaaacatcccaaatctgagacagctgttatcttacctaatcttaataatttctagcattttcctattcataatgattgagatggtaattcagagtcatgtagaaa

SEQ ID NO: 298607 - DNA, 395 bp, Homo sapiens
gtaagactcagcttacctctctgttatatcacttgggagttttggttttggcagtctgatagcatgaagtatctctgttcctttgctcttgggtgggtttggtgttggggggcaactggcaaatgaccctaataactagattatttttgtgtgtggagcttgtatcattttatggtaataccagttatcctgttatttcagatggccagttcttcacctggggaaagaacagccatgggcagcttggcttagggaaggagttcccctcccaagccagcccacagagggtgaggtccctggaggggatcccactggctcaggtggctgccggaggggctcacagctttgccctgtctctctcaggagctgtttttggctgggggatgaataatgcc

SEQ ID NO: 298608 - DNA, 661 bp, Homo sapiens
gccacttttccttttctgtcattctatgattaggagtctccaagagcttttagattaccccggggaggatgtggaggagactttctgcctcaacttcacggtaagaatttccacagtttacttaggattgtggctgtctctcttaccatctttagagtgatatttaacattagttcttcttcaaatcatagaaaaaagtcagagacttctttgaatcaaattattttagtcatagtgtcttgagtgttataggggttcagtgggcgtgttgaataaatgaatgaatgattaatctgttatttattgcatttattggcaactccatgtcctaaaacaaaagatgttttttaacctgctaatgttttctgactcaagttctgattattctcccactaattttctgtaatagtcatgaaactacatttgttcctaaagcctctctcagtcatttgagttctagaaagatgaatggttaacaaaattgaaatatttcttttttccaccttaaatatagatctgccgagaaagctatggagtgattgaacagaagaagctgatacctgggggagataatgtaactgtgtgcaaggataacaggttagtcctgaccttggactgttgcagatactgctacttcatatttctgcagttttacatttaa

SEQ ID NO: 298609 - DNA, 510 bp, Homo sapiens
gagtaagaaaattctacatgattaaagaatccatgtaagtctaattttaaattcctagtaactagagaaaagacttatttatataaaatgaagtatttatgaactgtgataaagcatcaaatcttgatgaaggattgtagatttttgctttttctttttgtttttaaaacttattccaattgctaaattggtagtttttcagtctttataaatacaggattaaaaatatatatacagttatatgaaatgtttattttctatgtgtgtgcatatagttcaatattatgcaataaatttggtgttttaacttaaaactatttcttattgtacttgcagaatggatagcttgcttttagtagaagcattaggtcgtatactcagataatctaatagaaggtcagatttgattcctgcataagaaagtagagccaagtgctgcagaaatggagaagaaagcaggggcaaggagcagatggcattaaggaagaatgaagtttttgaaggttggga

SEQ ID NO: 298610 - DNA, 1287 bp, Homo sapiens
  misc_feature (822)..(822): n is a, c, g, or t
cagagggcgggaggaagcgggaggaactccgtcgtcctccgcgcgcgcctgcccgcggctggggaaccaagggcctggaggggaaacagctccctgctgcgttgttttgggctccgtgagccgaaagggggaggggagacgaaggagaagcaaacactgcgcagcgggaccgtgcgcggcctccgctcctgcgtgcgtgcgctcgctcgcgcgggctcagtgctggcgcgtgaggcggaggcgggcggcggcggcggcgcctgcgcggtcggactcggtcgacggttcgcaggggaggaggcggcgggaggcggaggaggcggcggcggcgatggaggtgaagcggctgaaagtgaccgagctgcggtcggagctgcagcggcggggcctggactcgcgcggcctcaaggtggatctggcgcagcggctgcaggaggcgctggacgccgagatgctcgaggacgaggccggcggcggcggggccgggcccggcggggcctgcaaggcggagcctcggcctgtggccgcgtcgggcggcggcccgggcggggacgaggaggaggacgaagaggaggaggaggaggacgaggaggcgctgcttgaggacgaggacgaggagccaccccctgctcaagccttgggtcaggccgcgcagccgccgccggagcccccggaggcggcagccatggaggccgcggccgagccagatgcttccgagaagccggcggaggccacggccgggtcaggcggggtaaatggtggcgaagagcagggcctcggcaagagggaggaagacgaacccgaggagcggagcggagcggngacgagacgccgggatccgaggtgccgggtgacaaggccgccgaggaacagggagatgaccaggatagtgaaaagtcaaaaccttcgtctccctctcttttacccagagacagcacatacgtgtgcacacgcatgcacacacacattcagtattttaaaagaatgttttcttggtgccattttcattttattttattttttaattcttggagggggaaataagggaataaggccaaggaagatgtatagctttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaacttaaactttttggcttgcaaaatatttttgtaataaagatttctgggtaataat

SEQ ID NO: 298611 - DNA, 288 bp, Homo sapiens
gggtacaggcgcgaggaacagggagatgaccaggatagtgaaaagtcaaaaccagcaggctcagatggtgagcggcggggggtaaagagacagcgggatgagaaggatgaacatggccgagcttactatgaattccgagaggaggcttaccacagccgctcaaagtctccactgcctcctgaagaagaggcaaaagatgaggaggaggatcaaactcttgtgaacctggacacgtgaccgacctggattcgcgaccgacctggattcgcgaccgacctggattcgcga

SEQ ID NO: 298612 - DNA, 3610 bp, Homo sapiens
  misc_feature (33)..(33): n is a, c, g, or t
tacactaaaggcgaggccggctagcggagcggngacgagacgccgggatccgaggtgccgggtgacaaggccgccgaggaacagggagatgaccaggatagtgaaaagtcaaaaccagcaggctcagatggtgagcggcggggggtaaagagacagcgggatgagaaggatgaacatggccgagcttactatgaattccgagaggaggcttaccacagccgctcaaagtctccactgcctcctgaagaagaggcaaaagatgaggaggaggatcaaactcttgtgaacctggacacgtatacctcggatctgcattttcaagtgagcaaagaccgctatggagggcagccacttttctcagagaagttccccaccctttggtctggggcaaggagtacttacggagtgacaaagggaaaagtctgctttgaggcaaaggtaacccagaatctcccaatgaaagaaggctgcacagaggtctctctccttcgagttgggtggtctgttgatttttcccgtccacagcttggtgaagatgaattctcttacggtttcgatggacgaggactcaaggcagaaaatggacaatttgaggaatttggccagacttttggggagaatgatgttattggctgctttgctaattttgagactgaagaagtagaactttccttctccaagaatggagaagacctaggtgtggcattctggatcagcaaggattccctggcagaccgggcccttctaccccatgtcctctgcaaaaattgtgttgtagaattaaacttcggtcagaaggaggagcccttcttcccaccaccagaagagtttgtgttcattcatgctgtgcctgttgaggagcgtgtacgcactgcagtccctcccaagaccatagaggaatgtgaggtgattctgatggtgggactacccggatctggaaagacccagtgggcactgaaatatgcaaaagaaaaccctgagaaaagatacaatgtcctgggagctgagactgtgctcaatcaaatgaggatgaagggtctcgaggagccagagatggaccccaaaagccgagaccttttagttcagcaagcctcccagtgccttagtaagctggtccagattgcttcccggacaaagaggaactttattcttgatcagtgtaatgtgtacaattctggccaacggcggaagctattgctgttcaagaccttctctcggaaagtggtggtggttgtccctaatgaggaagattggaagaagaggctggagttgaggaaggaagtagagggagatgatgtgcctgaatctataatgctggagatgaaagccaacttctctttgcctgaaaaatgcgactatatggatgaggtgacatatggggagctggagaaggaggaagctcagcccattgtcactaagtacaaggaggaggcaaggaagcttctgcccccctccgagaagcggacaaatcgccgaaacaaccgaaacaagcgtaaccggcagaaccgaagccggggccaaggctatgtgggcgggcagcgccgaggctacgacaaccgggcctacgggcagcagtactgggggcagcctggaaacagagggggttaccgtaatttctatgatcgatacaggggagactatgatcgattttacgggcgagattatgagtacaacagatacagagactattacagacaatacaatcgggattggcagagttactactaccaccacccccaggacagagaccgatactacaggaattactacgggtaccaagggtatcggtgaagcccctgccatggtcacctgtcagccatgaagctgaatctctgggggtgccaggcacccccgcaaaacacaaccaaggaaaacaggggctgtcggggtggggctgagctgccggggaggggtggtggggggggagggtgctcaagcaggggtgggggaggggggaggtggaaacaaacaacaaaactgtacattttttttaaagtttgttgaaaagaatattgtcttattctataaaacatttcaaacctagttagagatttgtaatcaaaaaacatttgcgcagaaagcagcacttagggctgcctgttctataccctacagtcagacaggaaaagaactgaaaatggcacccttctgacattctgaggcagctggactggcagccaagtaaaggagagtgatgaggtggtgtggggagggtggggaggcagcgcgagggtgctctccacagcaggtaggagcaggcaggagtggggacagagggagagcttgtgactgggacagtgaaaataaacgattggctcttatcaatcacttgcaccaactaaccgtttgtattttctttaccgacctttcccttttgggatatgtggtctggtgggctgggaggcttacagtgtcccaactctccattttcctgtgcctttgtgctgtttggctgaggcatggagactgccagtgggtggttctattttacaggattcccaggccaagaaagcctggggactgtccttgatggcagagcagaatagcctgccccttctatagacccattgattaattcctgtaaaatcttggggagaatgggattgcagccctcagcctaaagattgtgatttgccagtctctagtctctgtcttccaaggttgagagaggtgggaggtctctgaaatcatccctgttagagtgtctgtcctcttacagtgcgagagaaggaacgtttctcagggtttcagctcacacgaaaacacagcaggattcttttcactgcagcgggatatgtatataggtgaatcctgtggtgtgggctcacaggcccaggtgctgagaatagcaactagcaactattttctacagtgtggagggctcgtgccctgctggtttttttgatacacaggtagagaatgaatagaagaggggagggtggtgggggggggtgggaggcagctcagtggggctgctgaaccttgggaagagtgtgagtgtgaacgtgtgtaaatgtgcgtgtgaaagggagcaccccttcccgacttctagaaacaaaattccttttggggcgctttccctgtgtgtccccagagaggcctctagccaggagccttcagttgggatagtttcatttgtgactttaccaataccctcccagttcttgatagacagctgtaggttgctgggttcaagaatatgggtgggatatggaatgctctttcaatgtctagcttcagttttcattcatcctcctgctcagcactgtcagccaagagcttactcagcagacaccacatactgcagcagttcctagtgagaaaatctgtgccactagaaaatgcttcacttccatttcctcacctgggcagttctctgtttaaaattgtgggctgatttggtcttcctctcctcctcccactgttactgccctgcagcccttgttcaggtgtacaggacccttattctggcctctagtgtccttgtctgtcatgacacacccttccgcccaaatacctctgaccccaaggctggaatggggctggtaggagataagtttgcttactcatagtcatgtcctttctcttggcacctgcttccctgcggtgt

SEQ ID NO: 298613 - DNA, 4399 bp, Homo sapiens
  misc_feature (822)..(822): n is a, c, g, or t
cagagggcgggaggaagcgggaggaactccgtcgtcctccgcgcgcgcctgcccgcggctggggaaccaagggcctggaggggaaacagctccctgctgcgttgttttgggctccgtgagccgaaagggggaggggagacgaaggagaagcaaacactgcgcagcgggaccgtgcgcggcctccgctcctgcgtgcgtgcgctcgctcgcgcgggctcagtgctggcgcgtgaggcggaggcgggcggcggcggcggcgcctgcgcggtcggactcggtcgacggttcgcaggggaggaggcggcgggaggcggaggaggcggcggcggcgatggaggtgaagcggctgaaagtgaccgagctgcggtcggagctgcagcggcggggcctggactcgcgcggcctcaaggtggatctggcgcagcggctgcaggaggcgctggacgccgagatgctcgaggacgaggccggcggcggcggggccgggcccggcggggcctgcaaggcggagcctcggcctgtggccgcgtcgggcggcggcccgggcggggacgaggaggaggacgaagaggaggaggaggaggacgaggaggcgctgcttgaggacgaggacgaggagccaccccctgctcaagccttgggtcaggccgcgcagccgccgccggagcccccggaggcggcagccatggaggccgcggccgagccagatgcttccgagaagccggcggaggccacggccgggtcaggcggggtaaatggtggcgaagagcagggcctcggcaagagggaggaagacgaacccgaggagcggagcggagcggngacgagacgccgggatccgaggtgccgggtgacaaggccgccgaggaacagggagatgaccaggatagtgaaaagtcaaaaccagcaggctcagatggtgagcggcggggggtaaagagacagcgggatgagaaggatgaacatggccgagcttactatgaattccgagaggaggcttaccacagccgctcaaagtctccactgcctcctgaagaagaggcaaaagatgaggaggaggatcaaactcttgtgaacctggacacgtatacctcggatctgcattttcaagtgagcaaagaccgctatggagggcagccacttttctcagagaagttccccaccctttggtctggggcaaggagtacttacggagtgacaaagggaaaagtctgctttgaggcaaaggtaacccagaatctcccaatgaaagaaggctgcacagaggtctctctccttcgagttgggtggtctgttgatttttcccgtccacagcttggtgaagatgaattctcttacggtttcgatggacgaggactcaaggcagaaaatggacaatttgaggaatttggccagacttttggggagaatgatgttattggctgctttgctaattttgagactgaagaagtagaactttccttctccaagaatggagaagacctaggtgtggcattctggatcagcaaggattccctggcagaccgggcccttctaccccatgtcctctgcaaaaattgtgttgtagaattaaacttcggtcagaaggaggagcccttcttcccaccaccagaagagtttgtgttcattcatgctgtgcctgttgaggagcgtgtacgcactgcagtccctcccaagaccatagaggaatgtgaggtgattctgatggtgggactacccggatctggaaagacccagtgggcactgaaatatgcaaaagaaaaccctgagaaaagatacaatgtcctgggagctgagactgtgctcaatcaaatgaggatgaagggtctcgaggagccagagatggaccccaaaagccgagaccttttagttcagcaagcctcccagtgccttagtaagctggtccagattgcttcccggacaaagaggaactttattcttgatcagtgtaatgtgtacaattctggccaacggcggaagctattgctgttcaagaccttctctcggaaagtggtggtggttgtccctaatgaggaagattggaagaagaggctggagttgaggaaggaagtagagggagatgatgtgcctgaatctataatgctggagatgaaagccaacttctctttgcctgaaaaatgcgactatatggatgaggtgacatatggggagctggagaaggaggaagctcagcccattgtcactaagtacaaggaggaggcaaggaagcttctgcccccctccgagaagcggacaaatcgccgaaacaaccgaaacaagcgtaaccggcagaaccgaagccggggccaaggctatgtgggcgggcagcgccgaggctacgacaaccgggcctacgggcagcagtactgggggcagcctggaaacagagggggttaccgtaatttctatgatcgatacaggggagactatgatcgattttacgggcgagattatgagtacaacagatacagagactattacagacaatacaatcgggattggcagagttactactaccaccacccccaggacagagaccgatactacaggaattactacgggtaccaagggtatcggtgaagcccctgccatggtcacctgtcagccatgaagctgaatctctgggggtgccaggcacccccgcaaaacacaaccaaggaaaacaggggctgtcggggtggggctgagctgccggggaggggtggtggggggggagggtgctcaagcaggggtgggggaggggggaggtggaaacaaacaacaaaactgtacattttttttaaagtttgttgaaaagaatattgtcttattctataaaacatttcaaacctagttagagatttgtaatcaaaaaacatttgcgcagaaagcagcacttagggctgcctgttctataccctacagtcagacaggaaaagaactgaaaatggcacccttctgacattctgaggcagctggactggcagccaagtaaaggagagtgatgaggtggtgtggggagggtggggaggcagcgcgagggtgctctccacagcaggtaggagcaggcaggagtggggacagagggagagcttgtgactgggacagtgaaaataaacgattggctcttatcaatcacttgcaccaactaaccgtttgtattttctttaccgacctttcccttttgggatatgtggtctggtgggctgggaggcttacagtgtcccaactctccattttcctgtgcctttgtgctgtttggctgaggcatggagactgccagtgggtggttctattttacaggattcccaggccaagaaagcctggggactgtccttgatggcagagcagaatagcctgccccttctatagacccattgattaattcctgtaaaatcttggggagaatgggattgcagccctcagcctaaagattgtgatttgccagtctctagtctctgtcttccaaggttgagagaggtgggaggtctctgaaatcatccctgttagagtgtctgtcctcttacagtgcgagagaaggaacgtttctcagggtttcagctcacacgaaaacacagcaggattcttttcactgcagcgggatatgtatataggtgaatcctgtggtgtgggctcacaggcccaggtgctgagaatagcaactagcaactattttctacagtgtggagggctcgtgccctgctggtttttttgatacacaggtagagaatgaatagaagaggggagggtggtgggggggggtgggaggcagctcagtggggctgctgaaccttgggaagagtgtgagtgtgaacgtgtgtaaatgtgcgtgtgaaagggagcaccccttcccgacttctagaaacaaaattccttttggggcgctttccctgtgtgtccccagagaggcctctagccaggagccttcagttgggatagtttcatttgtgactttaccaataccctcccagttcttgatagacagctgtaggttgctgggttcaagaatatgggtgggatatggaatgctctttcaatgtctagcttcagttttcattcatcctcctgctcagcactgtcagccaagagcttactcagcagacaccacatactgcagcagttcctagtgagaaaatctgtgccactagaaaatgcttcacttccatttcctcacctgggcagttctctgtttaaaattgtgggctgatttggtcttcctctcctcctcccactgttactgccctgcagcccttgttcaggtgtacaggacccttattctggcctctagtgtccttgtctgtcatgacacacccttccgcccaaatacctctgaccccaaggctggaatggggctggtaggagataagtttgcttactcatagtcatgtcctttctcttggcacctgcttccctgcggtgt

SEQ ID NO: 298614 - DNA, 2803 bp, Homo sapiens
  misc_feature (33)..(33): n is a, c, g, or t
  misc_feature (2372)..(2372): n is a, c, g, or t
  misc_feature (2375)..(2375): n is a, c, g, or t
tacactaaaggcgaggccggctagcggagcggngacgagacgccgggatccgaggtgccgggtgacaaggccgccgaggaacagggagatgaccaggatagtgaaaagtcaaaaccagcaggctcagatggtgagcggcggggggtaaagagacagcgggatgagaaggatgaacatggccgagcttactatgaattccgagaggaggcttaccacagccgctcaaagtctccactgcctcctgaagaagaggcaaaagatgaggaggaggatcaaactcttgtgaacctggacacgtatacctcggatctgcattttcaagtgagcaaagaccgctatggagggcagccacttttctcagagaagttccccaccctttggtctggggcaaggagtacttacggagtgacaaagggaaaagtctgctttgaggcaaaggtaacccagaatctcccaatgaaagaaggctgcacagaggtctctctccttcgagttgggtggtctgttgatttttcccgtccacagcttggtgaagatgaattctcttacggtttcgatggacgaggactcaaggcagaaaatggacaatttgaggaatttggccagacttttggggagaatgatgttattggctgctttgctaattttgagactgaagaagtagaactttccttctccaagaatggagaagacctaggtgtggcattctggatcagcaaggattccctggcagaccgggcccttctaccccatgtcctctgcaaaaattgtgttgtagaattaaacttcggtcagaaggaggagcccttcttcccaccaccagaagagtttgtgttcattcatgctgtgcctgttgaggagcgtgtacgcactgcagtccctcccaagaccatagaggaatgtgaggtgattctgatggtgggactacccggatctggaaagacccagtgggcactgaaatatgcaaaagaaaaccctgagaaaagatacaatgtcctgggagctgagactgtgctcaatcaaatgaggatgaagggtctcgaggagccagagatggaccccaaaagccgagaccttttagttcagcaagcctcccagtgccttagtaagctggtccagattgcttcccggacaaagaggaactttattcttgatcagtgtaatgtgtacaattctggccaacggcggaagctattgctgttcaagaccttctctcggaaagtggtggtggttgtccctaatgaggaagattggaagaagaggctggagttgaggaaggaagtagagggagatgatgtgcctgaatctataatgctggagatgaaagccaacttctctttgcctgaaaaatgcgactatatggatgaggtgacatatggggagctggagaaggaggaagctcagcccattgtcactaagtacaaggaggaggcaaggaagcttctgcccccctccgagaagcggacaaatcgccgaaacaaccgaaacaagcgtaaccggcagaaccgaagccggggccaaggctatgtgggcgggcagcgccgaggctacgacaaccgggcctacgggcagcagtactgggggcagcctggaaacagagggggttaccgtaatttctatgatcgatacaggggagactatgatcgattttacgggcgagattatgagtacaacagatacagagactattacagacaatacaatcgggattggcagagttactactaccaccacccccaggacagagaccgatactacaggaattactacgggtaccaagggtatcggtgaagcccctgccatggtcacctgtcagccatgaagctgaatctctgggggtgccaggcacccccgcaaaacacaaccaaggaaaacaggggctgtcggggtggggctgagctgccggggaggggtggtggggggggagggtgctcaagcaggggtgggggaggggggaggtggaaacaaacaacaaaactgtacattttttttaaagtttgttgaaaagaatattgtcttattctataaaacatttcaaacctagttagagatttgtaatcaaaaaacatttgcgcagaaagcagcacttagggctgcctgttctataccctacagtcagacaggaaaagaactgaaaatggcacccttctgacattctgaggcagctggactggcagccaagtaaaggagagtgatgaggtggtgtggggagggtggggaggcagcgcgagggtgctctccacagcaggtaggagcaggcaggagtggggacagagggagagcttgtgactgggacagtgaaaataaacgattggctcttatcaatcacttgcaccaactaaaaaaaaaaaagaaaaaaaaaaaaaaaaaanaanaaaagaaaaaaaaaaaaagaaaaacaaaaaaaaagaaagaaagaaaaagaaaagaaaagaagagaaaagaaaaaaagaaaaaagaagaaaaaaaacaaaaacagagagaaacaacaagaaaaggggggggcggcgacactagactacagcacgacgggaaggacacacaaacagaacacgaagcaacaggaagatcaaggcgaaagaaggccacacacaaaacaggcggcgtagacaacaaacagcgaccgacagcgcagcacgcaaaaaagaagaaaaacaagagaaggggcggagagaaaagagaaaagaagcgaaggaagaaggaagagaaaagaaacacatcaggcggggagggcaaagaagagaagaggaacgaacacagcggcaaaggaaaaccgcgagagagaacaaaaaaaaaagaggag

SEQ ID NO: 298615 - DNA, 3793 bp, Homo sapiens
cggagagagatgttatgtcggcacccgctctccctgatagatgcggagagcatccagaaacttccagaccagccctctcaccacacccagaagaggcctttcccatctggagagaagcttccagaccagcccttcacacaccacagccaggaggggcctttcccacctggagagaaacttccagaccggcccctcataccacagccaagaggggcctttctcacctggagagaaacttccagaccatcccctctcaccacagccaggagaggcctttcccaccggaagaagaaaatgatccggatcattttcttcttccggcggggggtaaagagacagcgggatgagaaggatgaacatggccgagcttactatgaattccgagaggaggcttaccacagccgctcaaagtctccactgcctcctgaagaagaggcaaaagatgaggaggaggatcaaactcttgtgaacctggacacgtatacctcggatctgcattttcaagtgagcaaagaccgctatggagggcagccacttttctcagagaagttccccaccctttggtctggggcaaggagtacttacggagtgacaaagggaaaagtctgctttgaggcaaaggtaacccagaatctcccaatgaaagaaggctgcacagaggtctctctccttcgagttgggtggtctgttgatttttcccgtccacagcttggtgaagatgaattctcttacggtttcgatggacgaggactcaaggcagaaaatggacaatttgaggaatttggccagacttttggggagaatgatgttattggctgctttgctaattttgagactgaagaagtagaactttccttctccaagaatggagaagacctaggtgtggcattctggatcagcaaggattccctggcagaccgggcccttctaccccatgtcctctgcaaaaattgtgttgtagaattaaacttcggtcagaaggaggagcccttcttcccaccaccagaagagtttgtgttcattcatgctgtgcctgttgaggagcgtgtacgcactgcagtccctcccaagaccatagaggaatgtgaggtgattctgatggtgggactacccggatctggaaagacccagtgggcactgaaatatgcaaaagaaaaccctgagaaaagatacaatgtcctgggagctgagactgtgctcaatcaaatgaggatgaagggtctcgaggagccagagatggaccccaaaagccgagaccttttagttcagcaagcctcccagtgccttagtaagctggtccagattgcttcccggacaaagaggaactttattcttgatcagtgtaatgtgtacaattctggccaacggcggaagctattgctgttcaagaccttctctcggaaagtggtggtggttgtccctaatgaggaagattggaagaagaggctggagttgaggaaggaagtagagggagatgatgtgcctgaatctataatgctggagatgaaagccaacttctctttgcctgaaaaatgcgactatatggatgaggtgacatatggggagctggagaaggaggaagctcagcccattgtcactaagtacaaggaggaggcaaggaagcttctgcccccctccgagaagcggacaaatcgccgaaacaaccgaaacaagcgtaaccggcagaaccgaagccggggccaaggctatgtgggcgggcagcgccgaggctacgacaaccgggcctacgggcagcagtactgggggcagcctggaaacagagggggttaccgtaatttctatgatcgatacaggggagactatgatcgattttacgggcgagattatgagtacaacagatacagagactattacagacaatacaatcgggattggcagagttactactaccaccacccccaggacagagaccgatactacaggaattactacgggtaccaagggtatcggtgaagcccctgccatggtcacctgtcagccatgaagctgaatctctgggggtgccaggcacccccgcaaaacacaaccaaggaaaacaggggctgtcggggtggggctgagctgccggggaggggtggtggggggggagggtgctcaagcaggggtgggggaggggggaggtggaaacaaacaacaaaactgtacattttttttaaagtttgttgaaaagaatattgtcttattctataaaacatttcaaacctagttagagatttgtaatcaaaaaacatttgcgcagaaagcagcacttagggctgcctgttctataccctacagtcagacaggaaaagaactgaaaatggcacccttctgacattctgaggcagctggactggcagccaagtaaaggagagtgatgaggtggtgtggggagggtggggaggcagcgcgagggtgctctccacagcaggtaggagcaggcaggagtggggacagagggagagcttgtgactgggacagtgaaaataaacgattggctcttatcaatcacttgcaccaactaaccgtttgtattttctttaccgacctttcccttttgggatatgtggtctggtgggctgggaggcttacagtgtcccaactctccattttcctgtgcctttgtgctgtttggctgaggcatggagactgccagtgggtggttctattttacaggattcccaggccaagaaagcctggggactgtccttgatggcagagcagaatagcctgccccttctatagacccattgattaattcctgtaaaatcttggggagaatgggattgcagccctcagcctaaagattgtgatttgccagtctctagtctctgtcttccaaggttgagagaggtgggaggtctctgaaatcatccctgttagagtgtctgtcctcttacagtgcgagagaaggaacgtttctcagggtttcagctcacacgaaaacacagcaggattcttttcactgcagcgggatatgtatataggtgaatcctgtggtgtgggctcacaggcccaggtgctgagaatagcaactagcaactattttctacagtgtggagggctcgtgccctgctggtttttttgatacacaggtagagaatgaatagaagaggggagggtggtgggggggggtgggaggcagctcagtggggctgctgaaccttgggaagagtgtgagtgtgaacgtgtgtaaatgtgcgtgtgaaagggagcaccccttcccgacttctagaaacaaaattccttttggggcgctttccctgtgtgtccccagagaggcctctagccaggagccttcagttgggatagtttcatttgtgactttaccaataccctcccagttcttgatagacagctgtaggttgctgggttcaagaatatgggtgggatatggaatgctctttcaatgtctagcttcagttttcattcatcctcctgctcagcactgtcagccaagagcttactcagcagacaccacatactgcagcagttcctagtgagaaaatctgtgccactagaaaatgcttcacttccatttcctcacctgggcagttctctgtttaaaattgtgggctgatttggtcttcctctcctcctcccactgttactgccctgcagcccttgttcaggtgtacaggacccttattctggcctctagtgtccttgtctgtcatgacacacccttccgcccaaatacctctgaccccaaggctggaatggggctggtaggagataagtttgcttactcatagtcatgtcctttctcttggcacctgcttccctgcggtgt

SEQ ID NO: 298616 - DNA, 3797 bp, Homo sapiens
  misc_feature (33)..(33): n is a, c, g, or t
tacactaaaggcgaggccggctagcggagcggngacgagacgccgggatccgaggtgccgggtgacaaggccgccgaggaacagggagatgaccaggatagtgaaaagtcaaaaccagcaggctcagatggtgagcggcggggggtaaagagacagcgggatgagaaggatgaacatggccgagcttactatgaattccgagaggaggcttaccacagccgctcaaagtctccactgcctcctgaagaagaggcaaaagatgaggaggaggatcaaactcttgtgaacctggacacgtgtatgtataaggcagacagactgtggtttttaactaatctcctaaaagtgattttggagattaaaacttcatagcctataaattctatgagactttgtatccactacaacaactggtatacttatgctctgttggcggcttacaagtattggacattggagtaaactgattgcttctttctttacagatacctcggatctgcattttcaagtgagcaaagaccgctatggagggcagccacttttctcagagaagttccccaccctttggtctggggcaaggagtacttacggagtgacaaagggaaaagtctgctttgaggcaaaggtaacccagaatctcccaatgaaagaaggctgcacagaggtctctctccttcgagttgggtggtctgttgatttttcccgtccacagcttggtgaagatgaattctcttacggtttcgatggacgaggactcaaggcagaaaatggacaatttgaggaatttggccagacttttggggagaatgatgttattggctgctttgctaattttgagactgaagaagtagaactttccttctccaagaatggagaagacctaggtgtggcattctggatcagcaaggattccctggcagaccgggcccttctaccccatgtcctctgcaaaaattgtgttgtagaattaaacttcggtcagaaggaggagcccttcttcccaccaccagaagagtttgtgttcattcatgctgtgcctgttgaggagcgtgtacgcactgcagtccctcccaagaccatagaggaatgtgaggtgattctgatggtgggactacccggatctggaaagacccagtgggcactgaaatatgcaaaagaaaaccctgagaaaagatacaatgtcctgggagctgagactgtgctcaatcaaatgaggatgaagggtctcgaggagccagagatggaccccaaaagccgagaccttttagttcagcaagcctcccagtgccttagtaagctggtccagattgcttcccggacaaagaggaactttattcttgatcagtgtaatgtgtacaattctggccaacggcggaagctattgctgttcaagaccttctctcggaaagtggtggtggttgtccctaatgaggaagattggaagaagaggctggagttgaggaaggaagtagagggagatgatgtgcctgaatctataatgctggagatgaaagccaacttctctttgcctgaaaaatgcgactatatggatgaggtgacatatggggagctggagaaggaggaagctcagcccattgtcactaagtacaaggaggaggcaaggaagcttctgcccccctccgagaagcggacaaatcgccgaaacaaccgaaacaagcgtaaccggcagaaccgaagccggggccaaggctatgtgggcgggcagcgccgaggctacgacaaccgggcctacgggcagcagtactgggggcagcctggaaacagagggggttaccgtaatttctatgatcgatacaggggagactatgatcgattttacgggcgagattatgagtacaacagatacagagactattacagacaatacaatcgggattggcagagttactactaccaccacccccaggacagagaccgatactacaggaattactacgggtaccaagggtatcggtgaagcccctgccatggtcacctgtcagccatgaagctgaatctctgggggtgccaggcacccccgcaaaacacaaccaaggaaaacaggggctgtcggggtggggctgagctgccggggaggggtggtggggggggagggtgctcaagcaggggtgggggaggggggaggtggaaacaaacaacaaaactgtacattttttttaaagtttgttgaaaagaatattgtcttattctataaaacatttcaaacctagttagagatttgtaatcaaaaaacatttgcgcagaaagcagcacttagggctgcctgttctataccctacagtcagacaggaaaagaactgaaaatggcacccttctgacattctgaggcagctggactggcagccaagtaaaggagagtgatgaggtggtgtggggagggtggggaggcagcgcgagggtgctctccacagcaggtaggagcaggcaggagtggggacagagggagagcttgtgactgggacagtgaaaataaacgattggctcttatcaatcacttgcaccaactaaccgtttgtattttctttaccgacctttcccttttgggatatgtggtctggtgggctgggaggcttacagtgtcccaactctccattttcctgtgcctttgtgctgtttggctgaggcatggagactgccagtgggtggttctattttacaggattcccaggccaagaaagcctggggactgtccttgatggcagagcagaatagcctgccccttctatagacccattgattaattcctgtaaaatcttggggagaatgggattgcagccctcagcctaaagattgtgatttgccagtctctagtctctgtcttccaaggttgagagaggtgggaggtctctgaaatcatccctgttagagtgtctgtcctcttacagtgcgagagaaggaacgtttctcagggtttcagctcacacgaaaacacagcaggattcttttcactgcagcgggatatgtatataggtgaatcctgtggtgtgggctcacaggcccaggtgctgagaatagcaactagcaactattttctacagtgtggagggctcgtgccctgctggtttttttgatacacaggtagagaatgaatagaagaggggagggtggtgggggggggtgggaggcagctcagtggggctgctgaaccttgggaagagtgtgagtgtgaacgtgtgtaaatgtgcgtgtgaaagggagcaccccttcccgacttctagaaacaaaattccttttggggcgctttccctgtgtgtccccagagaggcctctagccaggagccttcagttgggatagtttcatttgtgactttaccaataccctcccagttcttgatagacagctgtaggttgctgggttcaagaatatgggtgggatatggaatgctctttcaatgtctagcttcagttttcattcatcctcctgctcagcactgtcagccaagagcttactcagcagacaccacatactgcagcagttcctagtgagaaaatctgtgccactagaaaatgcttcacttccatttcctcacctgggcagttctctgtttaaaattgtgggctgatttggtcttcctctcctcctcccactgttactgccctgcagcccttgttcaggtgtacaggacccttattctggcctctagtgtccttgtctgtcatgacacacccttccgcccaaatacctctgaccccaaggctggaatggggctggtaggagataagtttgcttactcatagtcatgtcctttctcttggcacctgcttccctgcggtgt

SEQ ID NO: 298617 - DNA, 2559 bp, Homo sapiens
ggctagccagaggtaggacatgtggctgcaggcaatcaaaacaacaggtttactgctgttggtgctgctgcaaagttgctataaggatagggagagagaggcggaagtgtaatgtgtacaattctggccaacggcggaagctattgctgttcaagaccttctctcggaaagtggtggtggttgtccctaatgaggaagattggaagaagaggctggagttgaggaaggaagtagagggagatgatgtgcctgaatctataatgctggagatgaaagccaacttctctttgcctgaaaaatgcgactatatggatgaggtgacatatggggagctggagaaggaggaagctcagcccattgtcactaagtacaaggaggaggcaaggaagcttctgcccccctccgagaagcggacaaatcgccgaaacaaccgaaacaagcgtaaccggcagaaccgaagccggggccaaggctatgtgggcgggcagcgccgaggctacgacaaccgggcctacgggcagcagtactgggggcagcctggaaacagagggggttaccgtaatttctatgatcgatacaggggagactatgatcgattttacgggcgagattatgagtacaacagatacagagactattacagacaatacaatcgggattggcagagttactactaccaccacccccaggacagagaccgatactacaggaattactacgggtaccaagggtatcggtgaagcccctgccatggtcacctgtcagccatgaagctgaatctctgggggtgccaggcacccccgcaaaacacaaccaaggaaaacaggggctgtcggggtggggctgagctgccggggaggggtggtggggggggagggtgctcaagcaggggtgggggaggggggaggtggaaacaaacaacaaaactgtacattttttttaaagtttgttgaaaagaatattgtcttattctataaaacatttcaaacctagttagagatttgtaatcaaaaaacatttgcgcagaaagcagcacttagggctgcctgttctataccctacagtcagacaggaaaagaactgaaaatggcacccttctgacattctgaggcagctggactggcagccaagtaaaggagagtgatgaggtggtgtggggagggtggggaggcagcgcgagggtgctctccacagcaggtaggagcaggcaggagtggggacagagggagagcttgtgactgggacagtgaaaataaacgattggctcttatcaatcacttgcaccaactaaccgtttgtattttctttaccgacctttcccttttgggatatgtggtctggtgggctgggaggcttacagtgtcccaactctccattttcctgtgcctttgtgctgtttggctgaggcatggagactgccagtgggtggttctattttacaggattcccaggccaagaaagcctggggactgtccttgatggcagagcagaatagcctgccccttctatagacccattgattaattcctgtaaaatcttggggagaatgggattgcagccctcagcctaaagattgtgatttgccagtctctagtctctgtcttccaaggttgagagaggtgggaggtctctgaaatcatccctgttagagtgtctgtcctcttacagtgcgagagaaggaacgtttctcagggtttcagctcacacgaaaacacagcaggattcttttcactgcagcgggatatgtatataggtgaatcctgtggtgtgggctcacaggcccaggtgctgagaatagcaactagcaactattttctacagtgtggagggctcgtgccctgctggtttttttgatacacaggtagagaatgaatagaagaggggagggtggtgggggggggtgggaggcagctcagtggggctgctgaaccttgggaagagtgtgagtgtgaacgtgtgtaaatgtgcgtgtgaaagggagcaccccttcccgacttctagaaacaaaattccttttggggcgctttccctgtgtgtccccagagaggcctctagccaggagccttcagttgggatagtttcatttgtgactttaccaataccctcccagttcttgatagacagctgtaggttgctgggttcaagaatatgggtgggatatggaatgctctttcaatgtctagcttcagttttcattcatcctcctgctcagcactgtcagccaagagcttactcagcagacaccacatactgcagcagttcctagtgagaaaatctgtgccactagaaaatgcttcacttccatttcctcacctgggcagttctctgtttaaaattgtgggctgatttggtcttcctctcctcctcccactgttactgccctgcagcccttgttcaggtgtacaggacccttattctggcctctagtgtccttgtctgtcatgacacacccttccgcccaaatacctctgaccccaaggctggaatggggctggtaggagataagtttgcttactcatagtcatgtcctttctcttggcacctgcttccctgcggtgt

SEQ ID NO: 298618 - DNA, 2148 bp, Homo sapiens
  misc_feature (5)..(6): n is a, c, g, or t
  misc_feature (53)..(54): n is a, c, g, or t
gctcnntcctctctgctcagagcattcgcgctctcacagaagccccaatcacnncaggcattcgtgtgggcgggcagcgccgaggctacgacaaccgggcctacgggcagcagtactgggggcagcctggaaacagagggggttaccgtaatttctatgatcgatacaggggagactatgatcgattttacgggcgagattatgagtacaacagatacagagactattacagacaatacaatcgggattggcagagttactactaccaccacccccaggacagagaccgatactacaggaattactacgggtaccaagggtatcggtgaagcccctgccatggtcacctgtcagccatgaagctgaatctctgggggtgccaggcacccccgcaaaacacaaccaaggaaaacaggggctgtcggggtggggctgagctgccggggaggggtggtggggggggagggtgctcaagcaggggtgggggaggggggaggtggaaacaaacaacaaaactgtacattttttttaaagtttgttgaaaagaatattgtcttattctataaaacatttcaaacctagttagagatttgtaatcaaaaaacatttgcgcagaaagcagcacttagggctgcctgttctataccctacagtcagacaggaaaagaactgaaaatggcacccttctgacattctgaggcagctggactggcagccaagtaaaggagagtgatgaggtggtgtggggagggtggggaggcagcgcgagggtgctctccacagcaggtaggagcaggcaggagtggggacagagggagagcttgtgactgggacagtgaaaataaacgattggctcttatcaatcacttgcaccaactaaccgtttgtattttctttaccgacctttcccttttgggatatgtggtctggtgggctgggaggcttacagtgtcccaactctccattttcctgtgcctttgtgctgtttggctgaggcatggagactgccagtgggtggttctattttacaggattcccaggccaagaaagcctggggactgtccttgatggcagagcagaatagcctgccccttctatagacccattgattaattcctgtaaaatcttggggagaatgggattgcagccctcagcctaaagattgtgatttgccagtctctagtctctgtcttccaaggttgagagaggtgggaggtctctgaaatcatccctgttagagtgtctgtcctcttacagtgcgagagaaggaacgtttctcagggtttcagctcacacgaaaacacagcaggattcttttcactgcagcgggatatgtatataggtgaatcctgtggtgtgggctcacaggcccaggtgctgagaatagcaactagcaactattttctacagtgtggagggctcgtgccctgctggtttttttgatacacaggtagagaatgaatagaagaggggagggtggtgggggggggtgggaggcagctcagtggggctgctgaaccttgggaagagtgtgagtgtgaacgtgtgtaaatgtgcgtgtgaaagggagcaccccttcccgacttctagaaacaaaattccttttggggcgctttccctgtgtgtccccagagaggcctctagccaggagccttcagttgggatagtttcatttgtgactttaccaataccctcccagttcttgatagacagctgtaggttgctgggttcaagaatatgggtgggatatggaatgctctttcaatgtctagcttcagttttcattcatcctcctgctcagcactgtcagccaagagcttactcagcagacaccacatactgcagcagttcctagtgagaaaatctgtgccactagaaaatgcttcacttccatttcctcacctgggcagttctctgtttaaaattgtgggctgatttggtcttcctctcctcctcccactgttactgccctgcagcccttgttcaggtgtacaggacccttattctggcctctagtgtccttgtctgtcatgacacacccttccgcccaaatacctctgaccccaaggctggaatggggctggtaggagataagtttgcttactcatagtcatgtcctttctcttggcacctgcttccctgcggtgt

SEQ ID NO: 298619 - DNA, 2348 bp, Homo sapiens
  misc_feature (822)..(822): n is a, c, g, or t
cagagggcgggaggaagcgggaggaactccgtcgtcctccgcgcgcgcctgcccgcggctggggaaccaagggcctggaggggaaacagctccctgctgcgttgttttgggctccgtgagccgaaagggggaggggagacgaaggagaagcaaacactgcgcagcgggaccgtgcgcggcctccgctcctgcgtgcgtgcgctcgctcgcgcgggctcagtgctggcgcgtgaggcggaggcgggcggcggcggcggcgcctgcgcggtcggactcggtcgacggttcgcaggggaggaggcggcgggaggcggaggaggcggcggcggcgatggaggtgaagcggctgaaagtgaccgagctgcggtcggagctgcagcggcggggcctggactcgcgcggcctcaaggtggatctggcgcagcggctgcaggaggcgctggacgccgagatgctcgaggacgaggccggcggcggcggggccgggcccggcggggcctgcaaggcggagcctcggcctgtggccgcgtcgggcggcggcccgggcggggacgaggaggaggacgaagaggaggaggaggaggacgaggaggcgctgcttgaggacgaggacgaggagccaccccctgctcaagccttgggtcaggccgcgcagccgccgccggagcccccggaggcggcagccatggaggccgcggccgagccagatgcttccgagaagccggcggaggccacggccgggtcaggcggggtaaatggtggcgaagagcagggcctcggcaagagggaggaagacgaacccgaggagcggagcggagcggngacgagacgccgggatccgaggtgccgggtgacaaggccgccgaggaacagggagatgaccaggatagtgaaaagtcaaaaccagcaggctcagatggtgagcggcggggggtaaagagacagcgggatgagaaggatgaacatggccgagcttactatgaattccgagagcaggcaggagtggggacagagggagagcttgtgactgggacagtgaaaataaacgattggctcttatcaatcacttgcaccaactaaccgtttgtattttctttaccgacctttcccttttgggatatgtggtctggtgggctgggaggcttacagtgtcccaactctccattttcctgtgcctttgtgctgtttggctgaggcatggagactgccagtgggtggttctattttacaggattcccaggccaagaaagcctggggactgtccttgatggcagagcagaatagcctgccccttctatagacccattgattaattcctgtaaaatcttggggagaatgggattgcagccctcagcctaaagattgtgatttgccagtctctagtctctgtcttccaaggttgagagaggtgggaggtctctgaaatcatccctgttagagtgtctgtcctcttacagtgcgagagaaggaacgtttctcagggtttcagctcacacgaaaacacagcaggattcttttcactgcagcgggatatgtatataggtgaatcctgtggtgtgggctcacaggcccaggtgctgagaatagcaactagcaactattttctacagtgtggagggctcgtgccctgctggtttttttgatacacaggtagagaatgaatagaagaggggagggtggtgggggggggtgggaggcagctcagtggggctgctgaaccttgggaagagtgtgagtgtgaacgtgtgtaaatgtgcgtgtgaaagggagcaccccttcccgacttctagaaacaaaattccttttggggcgctttccctgtgtgtccccagagaggcctctagccaggagccttcagttgggatagtttcatttgtgactttaccaataccctcccagttcttgatagacagctgtaggttgctgggttcaagaatatgggtgggatatggaatgctctttcaatgtctagcttcagttttcattcatcctcctgctcagcactgtcagccaagagcttactcagcagacaccacatactgcagcagttcctagtgagaaaatctgtgccactagaaaatgcttcacttccatttcctcacctgggcagttctctgtttaaaattgtgggctgatttggtcttcctctcctcctcccactgttactgccctgcagcccttgttcaggtgtacaggacccttattctggcctctagtgtccttgtctgtcatgacacacccttccgcccaaatacctctgaccccaaggctggaatggggctggtaggagataagtttgcttactcatagtcatgtcctttctcttggcacctgcttccctgcggtgt

SEQ ID NO: 298620 - DNA, 333 bp, Homo sapiens
  misc_feature (33)..(33): n is a, c, g, or t
tacactaaaggcgaggccggctagcggagcggngacgagacgccgggatccgaggtgccgggtgacaaggccgccgaggaacagggagatgaccaggatagtgaaaagtcaaaaccagcaggctcagatggtgagcggcggggggtaaagagacagcgggatgagaaggatgaacatggccgagcttactatgaattccgagaggaggcttaccacagccgctcaaagtctccactgcctcctgaagaagaggcaaaagatgaggaggaggatcaaactcttgtgaacctggacacgtatacccgactcgcctttacgggatcctctagatca

SEQ ID NO: 298621 - DNA, 239 bp, Homo sapiens
caagtattggacattggagtaaactgattgcttctttctttacagatacctcggatctgcattttcaagtgagcaaagaccgctatggagggcagccacttttctcagagaagttccccaccctttggtctggggcaaggagtacttacggagtgacaaagggaaaagtctgctttgaggcaaaggtagctcattaagaccattcattcattcattcatttattactggatgcttacgg

SEQ ID NO: 298622 - DNA, 426 bp, Homo sapiens
ttattatagatcacttaagaacttgtaaatctacatagccctttgcctgggtctgttacaatttagggaaaacttagagtagaaaaagttaatgtcattatttagatgcgagtgggtataaacgtagcacatttttgtgcagtaatagatgaggcatagaaagtcatatgcttcttgtagagttttcataatgagttcttacccatctatgcacttttcaggcccacaagcttctctcttactcttatagccaacttctctttgcctgaaaaatgcgactatatggatgaggtgacatatggggagctggagaaggaggaagctcagcccattgtcactaagtacaaggaggaggcaaggaagcttctgcccccctccgagaagcggacaaatcgccgaaacaaccgaaacaagcgtaaccggcag

SEQ ID NO: 298623 - DNA, 4559 bp, Homo sapiens
tccttgggctctgttggcggcggcgctagcttcggagtctcccgcgcgcacctcagccgcctcctagcggcgcggcgctcgctcctacgcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaaggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacagcgattactttttgcaaaactctttggacatttaacatctgcaaggagggctcgaaaatctgaggttcctcatttccggttgaagaaagtacagaatataaaaatgtggctatctctccgttcctatcttaagcgtcgaggtcctcagcgatcagttgatgtaatagtttcatctgctttcttattgactatctcagttgtatttatctgttgtgcccagataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatcgtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagttgtaaaactgtatccaaattttcagaaaagacagcttcagcttgcaaattctatcctctaaacttatctggtgcattctccccaccccacccccattatataagggctattttagatgcttttaacctccccaacaaataatttgccaagtgtccaatgagaacttatcatgttggtgtgttaggtaaatcgggcaaatatgatagtgtcttacattgggccttgattttaagttgttatatttgtacaatcgagtattttagaaattacatgaaacatgaaacagtttttgcaattttttttaaactgggcatctggtttctaaaaatttatttgaaacaatctagaattttcttggtgcaaagtgtatcatgtggaatatcctcatatttttaccatattttaagaactttaagacgattaattgtaaataatttatttgattggtgcagttctaatccctaaatcataatcttaaaatcaggaatgtgtggagaacagagccatgtcatatcactttgctcttaccattccttttgatcagcctcaattcagcctcattgtgtagtatgttttttctttctatgaaaaacaacagaaagcatttcattttatttgcctatgttcaaatatgtttaataatgaccaaagtgcattctgagttttttcaaggaatgtaatactggagctttaagaacatacttagtttctcatgtgaaaacttaggctttgtctgatgtttttccttcctctattgtctaatgttgaggttgtttttaggaattatgttttataaactttttcaatataaggtacatgcctatacagaacttaacattttgcacagaatatatcaaatatattttgagaaaaaaagtacggcatgagttctgttaggaataaaagatgaaactattgtatctcacaaaaaatcttatttcagaatggaaatatttttgagaaaagtagctgagtatactggtttaagaaaatgcttgttttagattgaggttaacttagagttgggagttgatttattaagtacagtatacctctcaacagtttataaataatatgttgaattatgtcagtgtgggcagcagtagaatactaaaaggaaaatgtcatgttaagcaatttcagaacattaactgaactattttcaaagcagaaaaattgacattgctgcctttaagaataccatgaatgtaagaaattgaaagaaattgtaaaatatcacataatatagaaatggcagttcaaagagaattgtggcagatgttgtgtgtgaactgttgtttctttgccacatgtgttgtatttgaaagttttacagtaagtttaaaataaaacattctgtgactga

SEQ ID NO: 298624 - DNA, 4713 bp, Homo sapiens
tccttgggctctgttggcggcggcgctagcttcggagtctcccgcgcgcacctcagccgcctcctagcggcgcggcgctcgctcctacgcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaaggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacagcgattactttttgcaaaactctttggacatttaacatctgcaaggagggctcgaaaatctgaggttcctcatttccggttgaagaaagtacagaatataaaaatgtggctatctctccgttcctatcttaagcgtcgaggtcctcagcgatcagttgatgtaatagtttcatctgctttcttattgactatctcagttgtatttatctgttgtgcccagctacttcatgtacacgagatcttccttgattgtcactacaattgggaattggtaatctggtgcatctcgttaacactttttctcctaagatttgttacccttggatcagaaacaagtaaaaaatatagtaatacctcaatattacttactgaacataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatcgtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagttgtaaaactgtatccaaattttcagaaaagacagcttcagcttgcaaattctatcctctaaacttatctggtgcattctccccaccccacccccattatataagggctattttagatgcttttaacctccccaacaaataatttgccaagtgtccaatgagaacttatcatgttggtgtgttaggtaaatcgggcaaatatgatagtgtcttacattgggccttgattttaagttgttatatttgtacaatcgagtattttagaaattacatgaaacatgaaacagtttttgcaattttttttaaactgggcatctggtttctaaaaatttatttgaaacaatctagaattttcttggtgcaaagtgtatcatgtggaatatcctcatatttttaccatattttaagaactttaagacgattaattgtaaataatttatttgattggtgcagttctaatccctaaatcataatcttaaaatcaggaatgtgtggagaacagagccatgtcatatcactttgctcttaccattccttttgatcagcctcaattcagcctcattgtgtagtatgttttttctttctatgaaaaacaacagaaagcatttcattttatttgcctatgttcaaatatgtttaataatgaccaaagtgcattctgagttttttcaaggaatgtaatactggagctttaagaacatacttagtttctcatgtgaaaacttaggctttgtctgatgtttttccttcctctattgtctaatgttgaggttgtttttaggaattatgttttataaactttttcaatataaggtacatgcctatacagaacttaacattttgcacagaatatatcaaatatattttgagaaaaaaagtacggcatgagttctgttaggaataaaagatgaaactattgtatctcacaaaaaatcttatttcagaatggaaatatttttgagaaaagtagctgagtatactggtttaagaaaatgcttgttttagattgaggttaacttagagttgggagttgatttattaagtacagtatacctctcaacagtttataaataatatgttgaattatgtcagtgtgggcagcagtagaatactaaaaggaaaatgtcatgttaagcaatttcagaacattaactgaactattttcaaagcagaaaaattgacattgctgcctttaagaataccatgaatgtaagaaattgaaagaaattgtaaaatatcacataatatagaaatggcagttcaaagagaattgtggcagatgttgtgtgtgaactgttgtttctttgccacatgtgttgtatttgaaagttttacagtaagtttaaaataaaacattctgtgactga

SEQ ID NO: 298625 - DNA, 4581 bp, Homo sapiens
tccttgggctctgttggcggcggcgctagcttcggagtctcccgcgcgcacctcagccgcctcctagcggcgcggcgctcgctcctacgcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaaggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacagcgtcgaggtcctcagcgatcagttgatgtaatagtttcatctgctttcttattgactatctcagttgtatttatctgttgtgcccagctacttcatgtacacgagatcttccttgattgtcactacaattgggaattggtaatctggtgcatctcgttaacactttttctcctaagatttgttacccttggatcagaaacaagtaaaaaatatagtaatacctcaatattacttactgaacataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatcgtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagttgtaaaactgtatccaaattttcagaaaagacagcttcagcttgcaaattctatcctctaaacttatctggtgcattctccccaccccacccccattatataagggctattttagatgcttttaacctccccaacaaataatttgccaagtgtccaatgagaacttatcatgttggtgtgttaggtaaatcgggcaaatatgatagtgtcttacattgggccttgattttaagttgttatatttgtacaatcgagtattttagaaattacatgaaacatgaaacagtttttgcaattttttttaaactgggcatctggtttctaaaaatttatttgaaacaatctagaattttcttggtgcaaagtgtatcatgtggaatatcctcatatttttaccatattttaagaactttaagacgattaattgtaaataatttatttgattggtgcagttctaatccctaaatcataatcttaaaatcaggaatgtgtggagaacagagccatgtcatatcactttgctcttaccattccttttgatcagcctcaattcagcctcattgtgtagtatgttttttctttctatgaaaaacaacagaaagcatttcattttatttgcctatgttcaaatatgtttaataatgaccaaagtgcattctgagttttttcaaggaatgtaatactggagctttaagaacatacttagtttctcatgtgaaaacttaggctttgtctgatgtttttccttcctctattgtctaatgttgaggttgtttttaggaattatgttttataaactttttcaatataaggtacatgcctatacagaacttaacattttgcacagaatatatcaaatatattttgagaaaaaaagtacggcatgagttctgttaggaataaaagatgaaactattgtatctcacaaaaaatcttatttcagaatggaaatatttttgagaaaagtagctgagtatactggtttaagaaaatgcttgttttagattgaggttaacttagagttgggagttgatttattaagtacagtatacctctcaacagtttataaataatatgttgaattatgtcagtgtgggcagcagtagaatactaaaaggaaaatgtcatgttaagcaatttcagaacattaactgaactattttcaaagcagaaaaattgacattgctgcctttaagaataccatgaatgtaagaaattgaaagaaattgtaaaatatcacataatatagaaatggcagttcaaagagaattgtggcagatgttgtgtgtgaactgttgtttctttgccacatgtgttgtatttgaaagttttacagtaagtttaaaataaaacattctgtgactga

SEQ ID NO: 298626 - DNA, 4708 bp, Homo sapiens
cagagtgctatgtctgcatgctgttcagtctccttttggaaggtgggaaataaagtcatttgtatgtttttctctcttgcacagcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaaggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacagcgattactttttgcaaaactctttggacatttaacatctgcaaggagggctcgaaaatctgaggttcctcatttccggttgaagaaagtacagaatataaaaatgtggctatctctccgttcctatcttaagcgtcgaggtcctcagcgatcagttgatgtaatagtttcatctgctttcttattgactatctcagttgtatttatctgttgtgcccagctacttcatgtacacgagatcttccttgattgtcactacaattgggaattggtaatctggtgcatctcgttaacactttttctcctaagatttgttacccttggatcagaaacaagtaaaaaatatagtaatacctcaatattacttactgaacataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatcgtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagttgtaaaactgtatccaaattttcagaaaagacagcttcagcttgcaaattctatcctctaaacttatctggtgcattctccccaccccacccccattatataagggctattttagatgcttttaacctccccaacaaataatttgccaagtgtccaatgagaacttatcatgttggtgtgttaggtaaatcgggcaaatatgatagtgtcttacattgggccttgattttaagttgttatatttgtacaatcgagtattttagaaattacatgaaacatgaaacagtttttgcaattttttttaaactgggcatctggtttctaaaaatttatttgaaacaatctagaattttcttggtgcaaagtgtatcatgtggaatatcctcatatttttaccatattttaagaactttaagacgattaattgtaaataatttatttgattggtgcagttctaatccctaaatcataatcttaaaatcaggaatgtgtggagaacagagccatgtcatatcactttgctcttaccattccttttgatcagcctcaattcagcctcattgtgtagtatgttttttctttctatgaaaaacaacagaaagcatttcattttatttgcctatgttcaaatatgtttaataatgaccaaagtgcattctgagttttttcaaggaatgtaatactggagctttaagaacatacttagtttctcatgtgaaaacttaggctttgtctgatgtttttccttcctctattgtctaatgttgaggttgtttttaggaattatgttttataaactttttcaatataaggtacatgcctatacagaacttaacattttgcacagaatatatcaaatatattttgagaaaaaaagtacggcatgagttctgttaggaataaaagatgaaactattgtatctcacaaaaaatcttatttcagaatggaaatatttttgagaaaagtagctgagtatactggtttaagaaaatgcttgttttagattgaggttaacttagagttgggagttgatttattaagtacagtatacctctcaacagtttataaataatatgttgaattatgtcagtgtgggcagcagtagaatactaaaaggaaaatgtcatgttaagcaatttcagaacattaactgaactattttcaaagcagaaaaattgacattgctgcctttaagaataccatgaatgtaagaaattgaaagaaattgtaaaatatcacataatatagaaatggcagttcaaagagaattgtggcagatgttgtgtgtgaactgttgtttctttgccacatgtgttgtatttgaaagttttacagtaagtttaaaataaaacattctgtgactga

SEQ ID NO: 298627 - DNA, 4624 bp, Homo sapiens
caggcaggagctaccacgcccggctctccatatatcttctaaaccttaacttgagaggaaaacaaaaaggggaagtgataccagagttacggaggaaaagctactgtctcaggaactgagaccatgggagggacatgatcacttttagaaagatacagtcagaagaaagaaggaaaaagagaggaagaaagtggctcctcctcctttttctaatgccttgtcgtcagaatttcacagtactccttggccctggattcaggcatggctggattgagaggctcggataatatcttcacttctttttgctgtagactttggtcttgctggtcacattcttaggttggctctttctaggtggtggctaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacagcgattactttttgcaaaactctttggacatttaacatctgcaaggagggctcgaaaatctgaggttcctcatttccggttgaagaaagtacagaatataaaaatgtggctatctctccgttcctatcttaagcgtcgaggtcctcagcgatcagttgatgtaatagtttcatctgctttcttattgactatctcagttgtatttatctgttgtgcccagctacttcatgtacacgagatcttccttgattgtcactacaattgggaattggtaatctggtgcatctcgttaacactttttctcctaagatttgttacccttggatcagaaacaagtaaaaaatatagtaatacctcaatattacttactgaacataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatcgtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagttgtaaaactgtatccaaattttcagaaaagacagcttcagcttgcaaattctatcctctaaacttatctggtgcattctccccaccccacccccattatataagggctattttagatgcttttaacctccccaacaaataatttgccaagtgtccaatgagaacttatcatgttggtgtgttaggtaaatcgggcaaatatgatagtgtcttacattgggccttgattttaagttgttatatttgtacaatcgagtattttagaaattacatgaaacatgaaacagtttttgcaattttttttaaactgggcatctggtttctaaaaatttatttgaaacaatctagaattttcttggtgcaaagtgtatcatgtggaatatcctcatatttttaccatattttaagaactttaagacgattaattgtaaataatttatttgattggtgcagttctaatccctaaatcataatcttaaaatcaggaatgtgtggagaacagagccatgtcatatcactttgctcttaccattccttttgatcagcctcaattcagcctcattgtgtagtatgttttttctttctatgaaaaacaacagaaagcatttcattttatttgcctatgttcaaatatgtttaataatgaccaaagtgcattctgagttttttcaaggaatgtaatactggagctttaagaacatacttagtttctcatgtgaaaacttaggctttgtctgatgtttttccttcctctattgtctaatgttgaggttgtttttaggaattatgttttataaactttttcaatataaggtacatgcctatacagaacttaacattttgcacagaatatatcaaatatattttgagaaaaaaagtacggcatgagttctgttaggaataaaagatgaaactattgtatctcacaaaaaatcttatttcagaatggaaatatttttgagaaaagtagctgagtatactggtttaagaaaatgcttgttttagattgaggttaacttagagttgggagttgatttattaagtacagtatacctctcaacagtttataaataatatgttgaattatgtcagtgtgggcagcagtagaatactaaaaggaaaatgtcatgttaagcaatttcagaacattaactgaactattttcaaagcagaaaaattgacattgctgcctttaagaataccatgaatgtaagaaattgaaagaaattgtaaaatatcacataatatagaaatggcagttcaaagagaattgtggcagatgttgtgtgtgaactgttgtttctttgccacatgtgttgtatttgaaagttttacagtaagtttaaaataaaacattctgtgactga

SEQ ID NO: 298628 - DNA, 4307 bp, Homo sapiens
tgcaacttaacctgacaattagatcatttcttaaataaaacttcaaaatatatttttaaccataataaaatgggcaaaattttgtttctagattttgttcaaagaccagatgatttactaagaattttttgataagttagggcatgtctcctagaattgttatctgtaagacctcaaaacctttaagctgaaataggacattaatttacatgtttattttagctgttagatatatttctaaattattatacaaatagggtggtcattaaaatttagagaaatagctatctgatgtaattattaacagattataatttctatcagtaacctatccaaaataagctaagtccaaacattcttctgcatattttaatttttagatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacagcgattactttttgcaaaactctttggacatttaacatctgcaaggagggctcgaaaatctgaggttcctcatttccggttgaagaaagtacagaatataaaaatgtggctatctctccgttcctatcttaagcgtcgaggtcctcagcgatcagttgatgtaatagtttcatctgctttcttattgactatctcagttgtatttatctgttgtgcccagctacttcatgtacacgagatcttccttgattgtcactacaattgggaattggtaatctggtgcatctcgttaacactttttctcctaagatttgttacccttggatcagaaacaagtaaaaaatatagtaatacctcaatattacttactgaacataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatcgtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagttgtaaaactgtatccaaattttcagaaaagacagcttcagcttgcaaattctatcctctaaacttatctggtgcattctccccaccccacccccattatataagggctattttagatgcttttaacctccccaacaaataatttgccaagtgtccaatgagaacttatcatgttggtgtgttaggtaaatcgggcaaatatgatagtgtcttacattgggccttgattttaagttgttatatttgtacaatcgagtattttagaaattacatgaaacatgaaacagtttttgcaattttttttaaactgggcatctggtttctaaaaatttatttgaaacaatctagaattttcttggtgcaaagtgtatcatgtggaatatcctcatatttttaccatattttaagaactttaagacgattaattgtaaataatttatttgattggtgcagttctaatccctaaatcataatcttaaaatcaggaatgtgtggagaacagagccatgtcatatcactttgctcttaccattccttttgatcagcctcaattcagcctcattgtgtagtatgttttttctttctatgaaaaacaacagaaagcatttcattttatttgcctatgttcaaatatgtttaataatgaccaaagtgcattctgagttttttcaaggaatgtaatactggagctttaagaacatacttagtttctcatgtgaaaacttaggctttgtctgatgtttttccttcctctattgtctaatgttgaggttgtttttaggaattatgttttataaactttttcaatataaggtacatgcctatacagaacttaacattttgcacagaatatatcaaatatattttgagaaaaaaagtacggcatgagttctgttaggaataaaagatgaaactattgtatctcacaaaaaatcttatttcagaatggaaatatttttgagaaaagtagctgagtatactggtttaagaaaatgcttgttttagattgaggttaacttagagttgggagttgatttattaagtacagtatacctctcaacagtttataaataatatgttgaattatgtcagtgtgggcagcagtagaatactaaaaggaaaatgtcatgttaagcaatttcagaacattaactgaactattttcaaagcagaaaaattgacattgctgcctttaagaataccatgaatgtaagaaattgaaagaaattgtaaaatatcacataatatagaaatggcagttcaaagagaattgtggcagatgttgtgtgtgaactgttgtttctttgccacatgtgttgtatttgaaagttttacagtaagtttaaaataaaacattctgtgactga

SEQ ID NO: 298629 - DNA, 5000 bp, Homo sapiens
tccttgggctctgttggcggcggcgctagcttcggagtctcccgcgcgcacctcagccgcctcctagcggcgcggcgctcgctcctacgcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaaggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacagcgattactttttgcaaaactctttggacatttaacatctgcaaggagggctcgaaaatctgaggttcctcatttccggttgaagaaagtacagaatataaaaatgtggctatctctccgttcctatcttaagcgtcgaggtcctcagcgatcagttgatgtaatagtttcatctgctttcttattgactatctcagttgtatttatctgttgtgcccagctacttcatgtacacgagatcttccttgattgtcactacaattgggaattggtaatctggtgcatctcgttaacactttttctcctaagatttgttacccttggatcagaaacaagtaaaaaatatagtaatacctcaatattacttactgaacataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatcgtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagttgtaaaactgtatccaaattttcagaaaagacagcttcagcttgcaaattctatcctctaaacttatctggtgcattctccccaccccacccccattatataagggctattttagatgcttttaacctccccaacaaataatttgccaagtgtccaatgagaacttatcatgttggtgtgttaggtaaatcgggcaaatatgatagtgtcttacattgggccttgattttaagttgttatatttgtacaatcgagtattttagaaattacatgaaacatgaaacagtttttgcaattttttttaaactgggcatctggtttctaaaaatttatttgaaacaatctagaattttcttggtgcaaagtgtatcatgtggaatatcctcatatttttaccatattttaagaactttaagacgattaattgtaaataatttatttgattggtgcagttctaatccctaaatcataatcttaaaatcaggaatgtgtggagaacagagccatgtcatatcactttgctcttaccattccttttgatcagcctcaattcagcctcattgtgtagtatgttttttctttctatgaaaaacaacagaaagcatttcattttatttgcctatgttcaaatatgtttaataatgaccaaagtgcattctgagttttttcaaggaatgtaatactggagctttaagaacatacttagtttctcatgtgaaaacttaggctttgtctgatgtttttccttcctctattgtctaatgttgaggttgtttttaggaattatgttttataaactttttcaatataaggtacatgcctatacagaacttaacattttgcacagaatatatcaaatatattttgagaaaaaaagtacggcatgagttctgttaggaataaaagatgaaactattgtatctcacaaaaaatcttatttcagaatggaaatatttttgagaaaagtagctgagtatactggtttaagaaaatgcttgttttagattgaggttaacttagagttgggagttgatttattaagtacagtatacctctcaacagtttataaataatatgttgaattatgtcagtgtgggcagcagtagaatactaaaaggaaaatgtcatgttaagcaatttcagaacattaactgaactattttcaaagcagaaaaattgacattgctgcctttaagaataccatgaatgtaagaaattgaaagaaattgtaaaatatcacataatatagaaatggcagttcaaagagaattgtggcagatgttgtgtgtgaactgttgtttctttgccacatgtgttgtatttgaaagttttacagtaagtttaaaataaaacattctgtgactgacggtgttttttttttttaattttcaggtcatatacatttctatggtaattttgtgtttacttaacataaaatttagttagatttggggggagtgaaaataaattttttataactttccaacattttagattttgttatgattcttagaacatgaaagaataatacacaggtttttcatcaccaaaatgatattatatcattaatgtttgtttgcttctttgtttttgaatacagcaaactggctgtggcctgaaatattaaagctcattgtgaaaagaaaaaaaaaa

SEQ ID NO: 298630 - DNA, 1910 bp, Homo sapiens
tccttgggctctgttggcggcggcgctagcttcggagtctcccgcgcgcacctcagccgcctcctagcggcgcggcgctcgctcctacgcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaaggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacaggtgggtataatgtagacttccgaataagaatattttatcgttttcataatattaaaagtattcctgaagtactttattatttcattatatcatttttacctaattattttttattttgcttttatagtacctaaccaaataaaatcttaacaattcatat

SEQ ID NO: 298631 - DNA, 1843 bp, Homo sapiens
tccttgggctctgttggcggcggcgctagcttcggagtctcccgcgcgcacctcagccgcctcctagcggcgcggcgctcgctcctacgcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaaggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgagtttttaaattttattcttgtagttcaagggtaagacttagtaattatatataagataattactggaatattatattagtaaccttctgacctcatttcttcaccgtgaaaaaaaagttacatgtgtgtatttgtttctgtctgtaatttaaacagtgatttgtcaccaaaccactctcatcttctagtgttttcacttatctgaccaagaatagatgatacggtctataatttttctcttttatctttttctttcttttgaaattcaggagcttgttagatatatacaggtgttaataaagacttttctttggactagagattgttgttacaagaactttaaaaataaaaaaataattaaa

SEQ ID NO: 298632 - DNA, 1238 bp, Homo sapiens
tccttgggctctgttggcggcggcgctagcttcggagtctcccgcgcgcacctcagccgcctcctagcggcgcggcgctcgctcctacgcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaaggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggtatatactttgtccttaagtgtatacatacgtatctattttatatgttactaatttataacttctttcaacaattaaaaattgttgaaataaatatttcacattatta

SEQ ID NO: 298633 - DNA, 613 bp, Homo sapiens
gtaaatatccatccaatgcaatcctttcaatcttctgtccactgacctgccactataagcaaggaccaataccttaacatttctagaaattggtcttgaatatgcatcatgatatttggattaaattttatctagtaaatctaaattttattatgtgttaagtaaagttcctgtgtttatgttttccaaaattttgattgtactactgagaaagtggttattaaaatattaaagctgccttccattcttaatctcttctgatgaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcagggtttgtatttatttaaggttttatatggcatagagatggcactatcctttttctggcacttcagtctcaggtaatgaatattaattactttaaatgtgacagcctcattatggattttgttttgataaattataatagtatagataatggaaaaatagacactgtaaactttatttggctca

SEQ ID NO: 298634 - DNA, 625 bp, Homo sapiens
ctatgtctttcccttttagcactcatcacaatttatcacatatatctgtgattattaacttgatgtctcactcccctcctagttcctgtgaaggtagagggaccatgtgttgttctctgttgtatttgtagcacccagcacagtatctagtgctaagcaggtgcttaagaaatatttgtcgaataaatgacttgtgtttgacaaaatgaagtatttgaaagttataccaataattttatgctatataaatatagatacccttttaactctgttgcaattcctcaggaaatcataacactatcattaaaatttgcctaacaaattaggtatattcaacattgtgggctgtgatcaactgatggtgatgagtcaacacctttattgaaaccatggaaattatctgctgattagtaaatatattttaaaatgtttccttttctcccttccacccacaccctgcagcgtcgaggtcctcagcgatcagttgatgtaatagtttcatctgctttcttattgactatctcagttgtatttatctgttgtgcccaggtgagttaactcgctccatgtagaaattaaccagatatataaatattaactttcagattaataaataatcaaataa

SEQ ID NO: 298635 - DNA, 791 bp, Homo sapiens
agagtccgcctatcagccaatgaagagacagcagtgagagcggttgcgcagtgaaggctagacccggtttactggaattgctctggcgatcgaggggtcctagtacaccgcaatcatgtctattatgtcctataacggaggggccgtcatggccatgaaggggaagaactgtgtggccatcgctgcagacaggcgcttcgggatccaggcccagatggtgaccacggacttccagaagatctttcccatgggtgaccggctgtacatcggtctggccgggctcgccactgacgtccagacagttgcccagcgcctcaagttccggctgaacctgtatgagttgaaggaaggtcggcagatcaaaccttataccctcatgagcatggtggccaacctcttgtatgagaaacggtttggcccttactacactgagccagtcattgccgggttggacccgaagacctttaagcccttcatttgctctctagacctcatcggctgccccatggtgactgatgactttgtggtcagtggcacctgcgccgaacaaatgtacggaatgtgtgagtccctctgggagcccaacatggatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctttca

SEQ ID NO: 298636 - DNA, 260 bp, Homo sapiens
tatttacctctccttaatactcattagagactattattttcttcgcaaacggctacacgatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctttca

SEQ ID NO: 298637 - DNA, 261 bp, Homo sapiens
gggtaggaggcgaagtgtgctaatatgcgagcagcaaaaaaacctttaggaccactacagatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctttca

SEQ ID NO: 298638 - DNA, 258 bp, Homo sapiens
gcgttgaaattgcatcatcctcattcccaacccaacgccacgttatggacactacagatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctttca

SEQ ID NO: 298639 - DNA, 791 bp, Homo sapiens
  misc_feature (255)..(255): n is a, c, g, or t
atcccaacgcgctgtcgtcctgagcgacctgcacgcgcacaagcttcgggtggacccggtcaacttcaatgctccgtaagccactgcctgactggtgaccctggcctgcccacctcccacggctgagttcacccctttgcggtgacactgctctccctgtgacatagttccgtgtgctttcatgtgagctaccgtgcgtgacgctcacaagatagccgttaagcgtggagcctcggtggccatgcttcttgcccnctgtggtgcatctccgcacacgggaaccgttcgcgtcagcactcttacatcggtaatcagctcatcactggatcggtggtggcactacctctttgtatgagaaacggtttggcccttactacactgagccagtcattgccgggttggacccgaagacctttaagcccttcatttgctctctagacctcatcggctgccccatggtgactgatgactttgtggtcagtggcacctgcgccgaacaaatgtacggaatgtgtgagtccctctgggagcccaacatggatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccaccacgttttatagaaaccttattttttgaacagtaacattaggccctgttcttttcaaaacacacaaaaaggcaaaaaacgaaaacaggg

SEQ ID NO: 298640 - DNA, 297 bp, Homo sapiens
  misc_feature (22)..(22): n is a, c, g, or t
agtgctacctccacaaacagantgctacctccacagacaggcgcttcgggatccaggcccagatggtgaccacggacttccagaagatctttcccatgggtgaccggctgtacatcggtctggccgggctcgccactgacgtccagacagttgcccagcgcctcaagttccggctgaacctgtatgagttgaaggaaggtcggcagatcaaaccttataccctcatgagcatggtggccaacctcttgtatgagaaacgatccgatcacctgtttgtggagtacaataagcccgtaa

SEQ ID NO: 298641 - DNA, 745 bp, Homo sapiens
tttatttttcagtgtttttcatataaactgcctccaatcttttctctaaaggagtagaggtataaacatacacatagaggactgagtgatggtaggaccttgggtgaggagagggaggattagaagaaaacaattctgaaagaaagaaggagcacaagagggtcagaggtgagaaggatagaaaggtaagtgttgaagaaaagaaagtggaaaagtcttagaatatttctagctggcaggagaagggagagggagctggcctcagggaaaggtgatcttcctaaacaggtcctccatttccctttgggtctgggtctaggccggggccttgtctgaataggcttaaacatgaaagcgagccacaaaaacaagtgagaagagatgagatagtgcttgacggcgagggtcggctgtcgttattaagtgccagctcttccggccactggggaaagcaggtacagtctgctttcaagggcccactgcagtccagtgaagcaagacacatccaaatacctgttgaactgcagtttgttgggaagaggaggaaagaaagggtctgggggcaaaggtacaggaaggggcaggtatgctcagtgactggagagctgagcctggctggagtgtgggttaaacatggggagaaatgatgctggagactgagatgagacctcaaagggccttgaatgccatgccaaggagtttgaactctgtcctctgccataggaacctagggaatcaggtgcct

SEQ ID NO: 298642 - DNA, 1706 bp, Homo sapiens
agagtccgcctatcagccaatgaagagacagcagtgagagcggttgcgcagtgaaggctagacccggtttactggaattgctctggcgatcgaggggtcctagtacaccgcaatcatgtctattatgtcctataacggaggggccgtcatggccatgaaggggaagaactgtgtggccatcgctgcagacaggcgcttcgggatccaggcccagatggtgaccacggacttccagaagatctttcccatgggtgaccggctgtacatcggtctggccgggctcgccactgacgtccagacagttgcccagcgcctcaagttccggctgaacctgtatgagttgaaggaaggtcggcagatcaaaccttataccctcatgagcatggtggccaacctcttgtatgagaaacggtttggcccttactacactgagccagtcattgccgggttggacccgaagacctttaagcccttcatttgctctctagacctcatcggctgccccatggtgactgatgactttgtggtcagtggcacctgcgccgaacaaatgtacggaatgtgtgagtccctctgggagcccaacatggatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctttcaaaaaaaaaacaaaaaacaaaaaaaaaaaaaaaaaaaaaaaaaaaaaaaaaaaaaaaaaaaaaaaaaaaataacataaaaaacaaccaaaaagaacacaccaacactacataacaccaccacacaaaacaaccatacatccataaactaacaatacatatcatagtacacaccaaggacacaaataaaccctacttcaacacatcacacagacatacagcactccactctaacgaacactatactttctccttcctccctattcgtacatccacatgccacctcattatctatctcacacctcctacctactcatatcactacgcatactcaaacatagtcactacctatctactagcttcatcactcgctcgaggaggcaatcacgcccgatgtcgtctttctttcattcggatcagtagttagctgtgagtatcattatcgtgggtgattgattgtcgttggtcttgtctgtatcatgtttcggtgtggtcgagcaggtgacggtggctggtcagtggcgttcttgtcctcgccagtggatgggtgtggcgtgatggtacactcattattgttttgcctgtgtgttctctatcccaacacctcttctcacatcatactctaaaactcaatccgcttccactcaccctctcgatacaacttcacactcatctaactctcacactcaccctcccactatactttaaccacctacaattactcatagcacatttttccatctacaaccacaccatataatactacttatgtcagtaattaaagacaataagtagcagtcagctccaccacctgcgatgcactctcttcactataatcaaatctccaccaacacacaacctaaccttaaacaaaacctaaacgaactaataacaacacacaaacacccactcacactt

SEQ ID NO: 298643 - DNA, 1153 bp, Homo sapiens
agagtccgcctatcagccaatgaagagacagcagtgagagcggttgcgcagtgaaggctagacccggtttactggaattgctctggcgatcgaggggtcctagtacaccgcaatcatgtctattatgtcctataacggaggggccgtcatggccatgaaggggaagaactgtgtggccatcgctgcagacaggcgcttcgggatccaggcccagatggtgaccacggacttccagaagatctttcccatgggtgaccggctgtacatcggtctggccgggctcgccactgacgtccagacagttgcccagcgcctcaagttccggctgaacctgtatgagttgaaggaaggtcggcagatcaaaccttataccctcatgagcatggtggccaacctcttgtatgagaaacggtttggcccttactacactgagccagtcattgccgggttggacccgaagacctttaagcccttcatttgctctctagacctcatcggctgccccatggtgactgatgactttgtggtcagtggcacctgcgccgaacaaatgtacggaatgtgtgagtccctctgggagcccaacatggatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctttcaaaaaaaaaacaaaaaacaaaaaaaaaaaaaaaaaaaaaaaaaaaaaaaaaaaaaaaaaaaaaaagggggggggggggggggcccccaaaaaaacgctttaaaaaaacacgagggggggcgagcgggggcccaaaagagagaaaagagaaaaagggggcaaaagaggggcccacaaagaaaacaggggcacaaaaacaggggggggaacctccacaaacaaaaaaaaacaccgggggggacaacaggagaggtttgagaaaaaccacaagagagggaggacaggggggaaaaagggggggaaaaacagagggagacaaaagaggcagcagcaacacaataaacccgacgcgggggggatgcga

SEQ ID NO: 298644 - DNA, 837 bp, Homo sapiens
agagtccgcctatcagccaatgaagagacagcagtgagagcggttgcgcagtgaaggctagacccggtttactggaattgctctggcgatcgaggggtcctagtacaccgcaatcatgtctattatgtcctataacggaggggccgtcatggccatgaaggggaagaactgtgtggccatcgctgcagacaggcgcttcgggatccaggcccagatggtgaccacggacttccagaagatctttcccatgggtgaccggctgtacatcggtctggccgggctcgccactgacgtccagacagttgcccagcgcctcaagttccggctgaacctgtatgagttgaaggaaggtcggcagatcaaaccttataccctcatgagcatggtggccaacctcttgtatgagaaacggtttggcccttactacactgagccagtcattgccgggttggacccgaagacctttaagcccttcatttgctctctagacctcatcggctgccccatggtgactgatgactttgtggtcagtggcacctgcgccgaacaaatgtacggaatgtgtgagtccctctgggagcccaacatggatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctttcagacagccatttaggttacagccatttatggtaacagccatttatac

SEQ ID NO: 298645 - DNA, 915 bp, Homo sapiens
agagtccgcctatcagccaatgaagagacagcagtgagagcggttgcgcagtgaaggctagacccggtttactggaattgctctggcgatcgaggggtcctagtacaccgcaatcatgtctattatgtcctataacggaggggccgtcatggccatgaaggggaagaactgtgtggccatcgctgcagacaggcgcttcgggatccaggcccagatggtgaccacggacttccagaagatctttcccatgggtgaccggctgtacatcggtctggccgggctcgccactgacgtccagacagttgcccagcgcctcaagttccggctgaacctgtatgagttgaaggaaggtcggcagatcaaaccttataccctcatgagcatggtggccaacctcttgtatgagaaacggtttggcccttactacactgagccagtcattgccgggttggacccgaagacctttaagcccttcatttgctctctagacctcatcggctgccccatggtgactgatgactttgtggtcagtggcacctgcgccgaacaaatgtacggaatgtgtgagtccctctgggagcccaacatggatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctttcatcaaaaaaaaaaatcatcccttaaaaacaaaacccgggggctttttcgggggggggagacaaaggtttttagtggcctggggatgtttttcgcccccttttttgcaaagggggaattgcggccc

SEQ ID NO: 298646 - DNA, 613 bp, Homo sapiens
agagtccgcctatcagccaatgaagagacagcagtgagagcggttgcgcagtgaaggctagacccggtttactggaattgctctggcgatcgaggggtcctagtacaccgcaatcatgtctattatgtcctataacggaggggccgtcatggccatgaaggggaagaactgtgtggccatcgctgcagacaggcgcttcgggatccaggcccagatggtgaccacggacttccagaagatctttcccatgggtgaccggctgtacatcggtctggccgggctcgccactgacgtccagacagttgcccagcgcctcaagttccggctgaacctgtatgagttgaaggaaggtcggcagatcaaaccttataccctcatgagcatggtggccaacctcttgtatgagaaacggatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctttca

SEQ ID NO: 298647 - DNA, 432 bp, Homo sapiens
ggagtcgtgaatggctcagtgtagtaagggccaacctcttgtatgagaaacggtttggcccttactacactgagccagtcattgccgggttggacccgaagacctttaagcccttcatttgctctctagacctcatcggctgccccatggtgactgatgactttgtggtcagtggcacctgcgccgaacaaatgtacggaatgtgtgagtccctctgggagcccaacatggatccggatcacctgtttgaaaccatctcccaagccatgctgaatgctgtggaccgggatgcagtgtcaggcatgggagtcattgtccacatcatcgagaaggacaaaatcaccaccaggacactgaaggcccgaatggactaaccctgttcccagagcccacttttttttctttttttgaaataaaatagcctgtctttca

SEQ ID NO: 298648 - DNA, 472 bp, Homo sapiens
agagtccgcctatcagccaatgaagagacagcagtgagagcggttgcgcagtgaaggctagacccggtttactggaattgctctggcgatcgaggggtcctagtacaccgcaatcatgtctattatgtcctataacggaggggccgtcatggccatgaaggggaagaactgtgtggccatcgctgcagacaggcgcttcgggatccaggcccagatggtgaccacggacttccagaagatctttcccatgggtgaccggctgtacatcggtctggccgggctcgccactgacgtccagacagttgcccagcgcctcaagttccggctgaacctgtatgagttgaaggaaggtcggcagatcaaaccttataccctcatgagcatggtggccaacctcttgtatgagaaacgtaaccctgttcccagagcccacttttttttctttttttgaaataaaatagcctgtctttca

SEQ ID NO: 298649 - DNA, 142 bp, Homo sapiens
ctcagggaaaggtgatcttcctaaacaggtcctccatttccctttgggtctgggtctaggccggggccttgtctgaataggcttaaacatgaaagcgagcgttcttgagttctggtttctctctctgatgctggcccccaca

SEQ ID NO: 298650 - DNA, 371 bp, Homo sapiens
gctctaggaatatctctgaatctagaagtgttgcaatccaaaattttccaaatgtaacaaaagttttttaaaaaattaatctttctctgtaaaatctgatgacccattgaaaataataatactaaaactttggatcgggaagaaatataaacagcctgttcaataatttcaaaattctctccatttgtatttaataatatcttcctttgggattccaaaagaatatactttatatctttgcttggaaaaggttgggaaatgttccaatcccttgaaaatttgctgaggaacatttgccacatcacgcttatatatgccagtttaagttacgacatattttgtaaactgcagttttaaagaaagaacagcac

SEQ ID NO: 298651 - DNA, 2817 bp, Homo sapiens
ctgcccggggaaagtccgggcagagcccgagcagcggccagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtgtctgcctataggagggggagctgttagggggtagacctagccaaggagaagtgggagacgtttggctagcaccccaggaagatgtgagagggagcaagcaaggttagcaactgtgaacagagaggtcgggatttgccctgggggaggaagagaggccaagttcagagctctctgtctcccccagccagacacctgcatccctggctcctctattactcaggggcattcatgcctggacttaaacaatactatgttatcttttcttttatttttctaatgaggtcctgggcagagagtgaaaaggcctctcctgattcctactgtcctaagctgcttttcttgaaatcatgacttgtttctaattctaccctcaggggcctgtagatgttgctttccagccaggaatctaaagctttgggttttctgagggggggaggagggaactggaggttattggggttaggatggaagggaactctgcacaaaacctttgctttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgttttttctccctggtgctcagagcacctgtgggaaaggttgctgtctgtctcagtacaatccaaatttgtcgtagacttgtgcaatatatactgttgtgggttggagaaaagtggaaagctacactgggaagaaactcccttccttcaatttctcagtgacattgatgaggggtcctcaaaagacctcgagtttcccaaaccgaatcaccttaagaaggacagggctagggcatttggccaggatggccaccctcctgctgttgccccttagtgaggaatcttcaccccacttcctctacccccaggttctcctccccacagccagtcccctttcctggatttctaaactgctcaattttgactcaaaggtgctatttaccaaacactctccctacccattcctgccagctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaaaaaatagggaggcggattacaattcactgcccgccgtttaccgtcgtgactgggcccctgcggtccct

SEQ ID NO: 298652 - DNA, 2749 bp, Homo sapiens
ctgcccggggaaagtccgggcagagcccgagcagcggccagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtgtctgcctataggagggggagctgttagggggtagacctagccaaggagaagtgggagacgtttggctagcaccccaggaagatgtgagagggagcaagcaaggttagcaactgtgaacagagaggtcgggatttgccctgggggaggaagagaggccaagttcagagctctctgtctcccccagccagacacctgcatccctggctcctctattactcaggggcattcatgcctggacttaaacaatactatgttatcttttcttttatttttctaatgaggtcctgggcagagagtgaaaaggcctctcctgattcctactgtcctaagctgcttttcttgaaatcatgacttgtttctaattctaccctcaggggcctgtagatgttgctttccagccaggaatctaaagctttgggttttctgagggggggaggagggaactggaggttattggggttaggatggaagggaactctgcacaaaacctttgctttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgttttttctccctggtgctcagagcacctgtgggaaaggttgctgtctgtctcagtacaatccaaatttgtcgtagacttgtgcaatatatactgttgtgggttggagaaaagtggaaagctacactgggaagaaactcccttccttcaatttctcagtgacattgatgaggggtcctcaaaagacctcgagtttcccaaaccgaatcaccttaagaaggacagggctagggcatttggccaggatggccaccctcctgctgttgccccttagtgaggaatcttcaccccacttcctctacccccaggttctcctccccacagccagtcccctttcctggatttctaaactgctcaattttgactcaaaggtgctatttaccaaacactctccctacccattcctgccagctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaa

SEQ ID NO: 298653 - DNA, 2787 bp, Homo sapiens
ctgcccggggaaagtccgggcagagcccgagcagcggccagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtgtctgcctataggagggggagctgttagggggtagacctagccaaggagaagtgggagacgtttggctagcaccccaggaagatgtgagagggagcaagcaaggttagcaactgtgaacagagaggtcgggatttgccctgggggaggaagagaggccaagttcagagctctctgtctcccccagccagacacctgcatccctggctcctctattactcaggggcattcatgcctggacttaaacaatactatgttatcttttcttttatttttctaatgaggtcctgggcagagagtgaaaaggcctctcctgattcctactgtcctaagctgcttttcttgaaatcatgacttgtttctaattctaccctcaggggcctgtagatgttgctttccagccaggaatctaaagctttgggttttctgagggggggaggagggaactggaggttattggggttaggatggaagggaactctgcacaaaacctttgctttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgttttttctccctggtgctcagagcacctgtgggaaaggttgctgtctgtctcagtacaatccaaatttgtcgtagacttgtgcaatatatactgttgtgggttggagaaaagtggaaagctacactgggaagaaactcccttccttcaatttctcagtgacattgatgaggggtcctcaaaagacctcgagtttcccaaaccgaatcaccttaagaaggacagggctagggcatttggccaggatggccaccctcctgctgttgccccttagtgaggaatcttcaccccacttcctctacccccaggttctcctccccacagccagtcccctttcctggatttctaaactgctcaattttgactcaaaggtgctatttaccaaacactctccctacccattcctgccagctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaaaatccatgaaaggggactggctgtggagagttgtcgac

SEQ ID NO: 298654 - DNA, 1517 bp, Homo sapiens
ccccgatcagtatatattgcacaagtctacgacaaatttggattgtactgagacagacagcaacctttcccacaggtgctcagagcacctgtgggaaagtttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgttttttctccctggtgctcagagcacctgtgggaaaggttgctgtctgtctcagtacaatccaaatttgtcgtagacttgtgcaatatatactgttgtgggttggagaaaagtggaaagctacactgggaagaaactcccttccttcaatttctcagtgacattgatgaggggtcctcaaaagacctcgagtttcccaaaccgaatcaccttaagaaggacagggctagggcatttggccaggatggccaccctcctgctgttgccccttagtgaggaatcttcaccccacttcctctacccccaggttctcctccccacagccagtcccctttcctggatttctaaactgctcaattttgactcaaaggtgctatttaccaaacactctccctacccattcctgccagctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaa

SEQ ID NO: 298655 - DNA, 1996 bp, Homo sapiens
ctgcccggggaaagtccgggcagagcccgagcagcggccagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtgtctgcctataggagggggagctgttagggggtagacctagccaaggagaagtgggagacgtttggctagcaccccaggaagatgtgagagggagcaagcaaggttagcaactgtgaacagagaggtcgggatttgccctgggggaggaagagaggccaagttcagagctctctgtctcccccagccagacacctgcatccctggctcctctattactcaggggcattcatgcctggacttaaacaatactatgttatcttttcttttatttttctaatgaggtcctgggcagagagtgaaaaggcctctcctgattcctactgtcctaagctgcttttcttgaaatcatgacttgtttctaattctaccctcaggggcctgtagatgttgctttccagccaggaatctaaagctttgggttttctgagggggggaggagggaactggaggttattggggttaggatggaagggaactctgcacaaaacctttgctttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgttttttctccctggtgctcagagcacctgtgggaaaggttgctgtctgtctcagtacaatccaaatttgtcgtagacttgtgcaatatataccttcggcatagggatcctctagatcaccc

SEQ ID NO: 298656 - DNA, 1962 bp, Homo sapiens
  misc_feature (1960)..(1960): n is a, c, g, or t
ctgcccggggaaagtccgggcagagcccgagcagcggccagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtgtctgcctataggagggggagctgttagggggtagacctagccaaggagaagtgggagacgtttggctagcaccccaggaagatgtgagagggagcaagcaaggttagcaactgtgaacagagaggtcgggatttgccctgggggaggaagagaggccaagttcagagctctctgtctcccccagccagacacctgcatccctggctcctctattactcaggggcattcatgcctggacttaaacaatactatgttatcttttcttttatttttctaatgaggtcctgggcagagagtgaaaaggcctctcctgattcctactgtcctaagctgcttttcttgaaatcatgacttgtttctaattctaccctcaggggcctgtagatgttgctttccagccaggaatctaaagctttgggttttctgagggggggaggagggaactggaggttattggggttaggatggaagggaactctgcacaaaacctttgctttgctagtgctgctttgtgtgtatgtgtggcaaataatttgggggtgatttgcaatgaaattttgggacccaaagagtatccactggggatgttttttggccaaaactcttccttttggaaccacatgaaagtcttgatgctgctgccatgatccctttgagaggtggctcaaaagctacagggaactccaggtcctttattactgccttcttttcaaaagcacaactctcctctaaccctcccctcccccttcccttctggtcgggtcatagagctaccgtattttctaggacaagagttctcagtcactgtgcaatatgccccctgggtcccaggagggtctggaggaaaactggctatcagaacctcctgatgccctggtgggcttagggaaccatctctcctgctctccttgggatgatggctggctagtcagccttgcatgtattccttggctgaatgggagagtgccccatgttctgcaagactacttggtattcttgtagggccgacactaaataaaagccaaaccttgggcactgttttttctccctggtgctcagagcacctgtgggaaaggttgctgtctgtctcagtacacccgccgtcggggactcctctagaacngc

SEQ ID NO: 298657 - DNA, 1301 bp, Homo sapiens
ctgcccggggaaagtccgggcagagcccgagcagcggccagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtgtctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaa

SEQ ID NO: 298658 - DNA, 835 bp, Homo sapiens
ggaggagtccacagaggcaaaattgagcagtttagaaatccaggaaaggggactgttgtgggttggagaaaagtggaaagctacactgggaagaaactcccttccttcaatttctcagtgacattgatgaggggtcctcaaaagacctcgagtttcccaaaccgaatcaccttaagaaggacagggctagggcatttggccaggatggccaccctcctgctgttgccccttagtgaggaatcttcaccccacttcctctacccccaggttctcctccccacagccagtcccctttcctggatttctaaactgctcaattttgactcaaaggtgctatttaccaaacactctccctacccattcctgccagctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaa

SEQ ID NO: 298659 - DNA, 758 bp, Homo sapiens
  misc_feature (18)..(18): n is a, c, g, or t
  misc_feature (36)..(36): n is a, c, g, or t
  misc_feature (61)..(61): n is a, c, g, or t
aatcacccccaaattatntgccacacatacacacanagcagcactagcaaagcaaaggttntgtgcagagttcccttccatcctaaccccaataacctccagttccctcctcctctgggtggccaggatggccaccctcctgctgttgccccttagtgaggaatcttcaccccacttcctctacccccaggttctcctccccacagccagtcccctttcctggatttctaaactgctcaattttgactcaaaggtgctatttaccaaacactctccctacccattcctgccagctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaa

SEQ ID NO: 298660 - DNA, 616 bp, Homo sapiens
gatagccgaagtcccgacgtagcccgacagtcccgactagcccgacagtcgactagcccgacagccagtcccctttcctggatttctaaactgctcaattttgactcaaaggtgctatttaccaaacactctccctacccattcctgccagctctgcctccttttcaactctccacattttgtattgccttcccagacctgcttccagtctttattgctttaaagttcactttgggcccacagacccaagagctaattttctggtttgtgggttgaaacaaagctgtgaatcactgcaggctgtgttcttgcatcttgtctgcaaacaggtccctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaa

SEQ ID NO: 298661 - DNA, 1121 bp, Homo sapiens
ctgcccggggaaagtccgggcagagcccgagcagcggccagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagagctatttatatatattatttttttttaagaaaggaggaaaagaaaccaaaagttttttttaagaaaaaaaatccttcaagggagctgcttggaagtggcctccccaggtgcctttggagagaactgttgcgtgcttgagtctgtgagccagtgtctgcctttttagaagcagcctcatggtctcatgcttaatcttgtctctcttctcttctttatgatgttcactttaaaaacaacaaaacccctgagctggactgttgagcaggcctgtctctcctattaagtaaaaataaatagtagtagtatgtttgtaagctattctgacagaaaagacaaaggttactaattgtatgatagtgtttttatatggaagaatgtacagcttatggacaaatgtacacctttttgttactttaataaaaatgtagtaggataaa

SEQ ID NO: 298662 - DNA, 712 bp, Homo sapiens
ctgcccggggaaagtccgggcagagcccgagcagcggccagggtaacgctgtcttgtggacccgcacttcccacccgagacctctcactgagcccgagccgcgcgcgacatgagccacgggaagggaaccgacatgctcccggagatcgccgccgccgtgggcttcctctccagcctcctgaggacccggggctgcgtgagcgagcagaggcttaaggtcttcagcggggcgctccaggaggcactcacagagcactacaaacaccactggtttcccgaaaagccgtccaagggctccggctaccgctgcattcgcatcaaccacaagatggaccccatcatcagcagggtggccagccagatcggactcagccagccccagctgcaccagctgctgcccagcgagctgaccctgtgggtggacccctatgaggtgtcctaccgcattggggaggacggctccatctgcgtcttgtacgaggaggccccactggccgcctcctgtgggctcctcacctgcaagaaccaagtgctgctgggccggagcagcccctccaagaactacgtgatggcagtctccagctaggcccttccgcccccgccctgggcgccgccgtgctcatgctgccgtgacaacaggccaccacatacctcaacctggggaactgtatttttaaatgaagttcagcaacaagactcgggatcctcagaa

SEQ ID NO: 298663 - DNA, 1788 bp, Homo sapiens
agcggagtgtttacttccgcttgacctggcccggacgccagaaaatgttccacgtgggataccctgcgtggggttcactgtagtagctgcactaggtgattcttggagcgggcctgagagacaaggacatgtggatcccagtggtcgggcttcctcggcggctgaggctctccgccttggcgggcgctggtcgcttttgcattttagggtctgaagcggcgacgcgaaagcatttgccggcgaggaaccactgtgggctctctgactcctctccgcagctgtggcccgaaccggatttcaggaatccgccaaggaaggcgtctaaggccagcttagactttaagcgttacgtaaccgatcggagattggctgagaccctggcgcaaatctatttgggaaaaccaagtagacctccacacctactgctggagtgcaatccaggtcctggaatcctgactcaggcattacttgaagctggtgccaaagtggttgcgctcgaaagtgacaaaacttttattccacatttggagtccttaggaaaaaatctggatggaaaactacgagtgattcactgtgacttctttaaactagatcctagaagtggtggagtaataaaaccacctgctatgtcttctcgagggctctttaagaatttgggaatagaagcagttccttggacagcagacatccctttaaaagtagttggaatgttcccaagtagaggtgagaaaagggcactttggaaactcgcatatgacttgtattcctgtacttctatatataaatttggacgaatagaagtaaatatgtttattggtgaaaaagaattccagaaactaatggcagatcccggaaatccagacttgtatcatgtattaagtgttatctggcaattagcttgtgagattaaggttctgcacatggagccttggtcatcatttgatatatacacccggaaagggccgctggaaaacccaaagcgtagggaattattagaccaattacaacaaaagctgtatcttattcaaatgattcctcgtcaaaatttatttaccaagaacttaacacctatgaactataatatattttttcacttgttaaagcactgttttgggaggcgcagcgccactgtaatagaccacttacgttcattgactccacttgatgcgagagatatattgatgcaaataggaaaacaggaggatgagaaagtagttaacatgcaccctcaagacttcaaaacactttttgaaactatagagcgttccaaagattgtgcttataaatggctgtatgatgaaaccctggaagataggtagcaactagactgtcgtttttggtggagcggttcatttatttggaaactatgacatgaaaaccaaatttgaaaactcacatcctttcagcagaaggtaactgttcttgtcttgcacaagccaggcagatcatttctcctaagctgatatcattggcttattggatgaaacagtgtctgctattttattcacaattgaataaaatgaaaacttcaattaattgtggatttgatcagattgaattcgttttgtttcagattcctatttaaatatttcacttgtactgttgctgatttttgcatcttcttgaagagcaagagtctgtacattattaagcttagaaagtaagcaaaactgatttactggtttgcctttcagtttgttgaaatgtattgtcaagtactgtacaatgaaattgtttaaattttaatatgatttaagctttttagaaattaaaatattttaaataaga

SEQ ID NO: 298664 - DNA, 2584 bp, Homo sapiens
agcggagtgtttacttccgcttgacctggcccggacgccagaaaatgttccacgtgggataccctgcgtggggttcactgtagtagctgcactaggtgattcttggagcgggcctgagagacaaggacatgtggatcccagtggtcgggcttcctcggcggctgaggctctccgccttggcgggcgctggtcgcttttgcattttagggtctgaagcggcgacgcgaaagcatttgccggcgaggaaccactgtgggctctctgactcctctccgcagctgtggcccgaaccggatttcaggaatccgccaaggaaggcgtctaaggccagcttagactttaagcgttacgtaaccgatcggagattggctgagaccctggcgcaaatctatttgggaaaaccaagtagacctccacacctactgctggagtgcaatccaggtcctggaatcctgactcaggcattacttgaagctggtgccaaagtggttgcgctcgaaagtgacaaaacttttattccacatttggagtccttaggaaaaaatctggatggaaaactacgagtgattcactgtgacttctttaaactagatcctagaagtggtggagtaataaaaccacctgctatgtcttctcgagggctctttaagaatttgggaatagaagcagttccttggacagcagacatccctttaaaagtagttggaatgttcccaagtagaggtgagaaaagggcactttggaaactcgcatatgacttgtattcctgtacttctatatataaatttggacgaatagaagtaaatatgtttattggtgaaaaagaattccagaaactaatggcagatcccggaaatccagacttgtatcatgtattaagtgttatctggcaattagcttgtgagattaaggttctgcacatggagccttggtcatcatttgatatatacacccggaaagggccgctggaaaacccaaagcgtagggaattattagaccaattacaacaaaagctgtatcttattcaaatgattcctcgtcaaaatttatttaccaagaacttaacacctatgaactataatatattttttcacttgttaaagcactgttttgggaggcgcagcgccactgtaatagaccacttacgttcattgactccacttgatgcgagagatatattgatgcaaataggaaaacaggaggatgagaaagtagttaacatgcaccctcaagacttcaaaacactttttgaaactatagagcgttccaaagattgtgcttataaatggctgtatgatgaaaccctggaagataggtagcaactagactgtcgtttttggtggagcggttcatttatttggaaactatgacatgaaaaccaaatttgaaaactcacatcctttcagcagaaggtaactgttcttgtcttgcacaagccaggcagatcatttctcctaagctgatatcattggcttattggatgaaacagtgtctgctattttattcacaattgaataaaatgaaaacttcaattaattgtggatttgatcagattgaattcgttttgtttcagattcctatttaaatatttcacttgtactgttgctgatttttgcatcttcttgaagagcaagagtctgtacattattaagcttagaaagtaagcaaaactgatttactggtttgcctttcagtttgttgaaatgtattgtcaagtactgtacaatgaaattgtttaaattttaatatgatttaagctttttagaaattaaaatattttaaataagaagattttgtggtttcttttggtctctaaatacctaatgaaacattaaactgaccctaatttactcctttttagttctgtcatgtagcgtcaatatagttttggtgaataattcagtctgtattactgaaaagtctgcacatttgttctatcaagaaaattcatctgaagttggatatgaacctaaatggaatttatgtgaacctaaatggaattaagaatattttcttggccaggcacagcggctcacgcctgtaatcccagcactttgggaggccaaggcgggcggatcacgaagtcaggagttcgagaccagcctggccaacacggtgaaaccccatctctactaaaagtacaaaaattagcctggtgtggtggtgggcacctgtaatcccagttactctggaggctgaggcaggagaatcgcttggacctgggaggcagaggttgcagtgagccgagatcataccactgcactccagcctgggtgacagagcaagactcagtctcggaaaaaaaaaaaaaaaaaaaagaatgttttcttgccaggaatggtggtgtgcacctgtagtcccagctactcaggaggtggaggagggaggacaactgagcccatgggtctagcctgggggcaacatggtgaaacccccatttctaaaaatattttataaaacagctgggcatggtggcaggttcctgtagtcccagcaacttcggaggctgaggtgagaggatcacttcagcccaagagttcgaggctgcagggagctattatttattgtacctgtgaagaacccc

SEQ ID NO: 298665 - DNA, 1865 bp, Homo sapiens
agcggagtgtttacttccgcttgacctggcccggacgccagaaaatgttccacgtgggataccctgcgtggggttcactgtagtagctgcactaggtgattcttggagcgggcctgagagacaaggacatgtggatcccagtggtcgggcttcctcggcggctgaggctctccgccttggcgggcgctggtcgcttttgcattttagggtctgaagcggcgacgcgaaagcatttgccggcgaggaaccactgtgggctctctgactcctctccgcagctgtggcccgaaccggatttcaggaatccgccaaggaaggcgtctaaggccagcttagactttaagcgttacgtaaccgatcggagattggctgagaccctggcgcaaatctatttgggaaaaccaagtagacctccacacctactgctggagtgcaatccaggtcctggaatcctgactcaggcattacttgaagctggtgccaaagtggttgcgctcgaaagtgacaaaacttttattccacatttggagggtctcactcccattgcccaggctggagtgcagtgctgcagtcacagctcactacagtctcaacttcccaggctcagtccttaggaaaaaatctggatggaaaactacgagtgattcactgtgacttctttaaactagatcctagaagtggtggagtaataaaaccacctgctatgtcttctcgagggctctttaagaatttgggaatagaagcagttccttggacagcagacatccctttaaaagtagttggaatgttcccaagtagaggtgagaaaagggcactttggaaactcgcatatgacttgtattcctgtacttctatatataaatttggacgaatagaagtaaatatgtttattggtgaaaaagaattccagaaactaatggcagatcccggaaatccagacttgtatcatgtattaagtgttatctggcaattagcttgtgagattaaggttctgcacatggagccttggtcatcatttgatatatacacccggaaagggccgctggaaaacccaaagcgtagggaattattagaccaattacaacaaaagctgtatcttattcaaatgattcctcgtcaaaatttatttaccaagaacttaacacctatgaactataatatattttttcacttgttaaagcactgttttgggaggcgcagcgccactgtaatagaccacttacgttcattgactccacttgatgcgagagatatattgatgcaaataggaaaacaggaggatgagaaagtagttaacatgcaccctcaagacttcaaaacactttttgaaactatagagcgttccaaagattgtgcttataaatggctgtatgatgaaaccctggaagataggtagcaactagactgtcgtttttggtggagcggttcatttatttggaaactatgacatgaaaaccaaatttgaaaactcacatcctttcagcagaaggtaactgttcttgtcttgcacaagccaggcagatcatttctcctaagctgatatcattggcttattggatgaaacagtgtctgctattttattcacaattgaataaaatgaaaacttcaattaattgtggatttgatcagattgaattcgttttgtttcagattcctatttaaatatttcacttgtactgttgctgatttttgcatcttcttgaagagcaagagtctgtacattattaagcttagaaagtaagcaaaactgatttactggtttgcctttcagtttgttgaaatgtattgtcaagtactgtacaatgaaattgtttaaattttaatatgatttaagctttttagaaattaaaatattttaaataaga

SEQ ID NO: 298666 - DNA, 1634 bp, Homo sapiens
agcggagtgtttacttccgcttgacctggcccggacgccagaaaatgttccacgtgggataccctgcgtggggttcactgtagtagctgcactaggtgattcttggagcgggcctgagagacaaggacatgtggatcccagtggtcgggcttcctcggcggctgaggctctccgccttggcgggcgctggtcgcttttgcattttagggtctgaagcggcgacgcgaaagcatttgccggcgaggaaccactgtgggctctctgactcctctccgcagctgtggcccgaaccggatttcaggaatccgccaaggaaggcgtctaaggccagcttagactttaagcgttacgtaaccgatcggagattggctgagaccctggcgcaaatctatttgggaaaaccaagtagacctccacacctactgctggagtgcaatccaggtcctggaatcctgactcaggcattacttgaagctggtgccaaagtggttgcgctcgaaagtgacaaaacttttattccacatttggagacatccctttaaaagtagttggaatgttcccaagtagaggtgagaaaagggcactttggaaactcgcatatgacttgtattcctgtacttctatatataaatttggacgaatagaagtaaatatgtttattggtgaaaaagaattccagaaactaatggcagatcccggaaatccagacttgtatcatgtattaagtgttatctggcaattagcttgtgagattaaggttctgcacatggagccttggtcatcatttgatatatacacccggaaagggccgctggaaaacccaaagcgtagggaattattagaccaattacaacaaaagctgtatcttattcaaatgattcctcgtcaaaatttatttaccaagaacttaacacctatgaactataatatattttttcacttgttaaagcactgttttgggaggcgcagcgccactgtaatagaccacttacgttcattgactccacttgatgcgagagatatattgatgcaaataggaaaacaggaggatgagaaagtagttaacatgcaccctcaagacttcaaaacactttttgaaactatagagcgttccaaagattgtgcttataaatggctgtatgatgaaaccctggaagataggtagcaactagactgtcgtttttggtggagcggttcatttatttggaaactatgacatgaaaaccaaatttgaaaactcacatcctttcagcagaaggtaactgttcttgtcttgcacaagccaggcagatcatttctcctaagctgatatcattggcttattggatgaaacagtgtctgctattttattcacaattgaataaaatgaaaacttcaattaattgtggatttgatcagattgaattcgttttgtttcagattcctatttaaatatttcacttgtactgttgctgatttttgcatcttcttgaagagcaagagtctgtacattattaagcttagaaagtaagcaaaactgatttactggtttgcctttcagtttgttgaaatgtattgtcaagtactgtacaatgaaattgtttaaattttaatatgatttaagctttttagaaattaaaatattttaaataaga

SEQ ID NO: 298667 - DNA, 1485 bp, Homo sapiens
agcggagtgtttacttccgcttgacctggcccggacgccagaaaatgttccacgtgggataccctgcgtggggttcactgtagtagctgcactaggtgattcttggagcgggcctgagagacaaggacatgtggatcccagtggtcgggcttcctcggcggctgaggctctccgccttggcgggcgctggtcgcttttgcattttagggtctgaagcggcgacgcgaaagcatttgccggcgaggaaccactgtgggctctctgactcctctccgcagctgtggcccgaaccggatttcaggaatccgccaaggaaggcgtctaaggccagcttagactttaagcgttacgtaaccgatcggagattggctgagaccctggcgcaaatctatttgggaaaaccaagtagacctccacacctactgctggagtgcaatccaggtcctggaatcctgactcaggcattacttgaagctggtgccaaagtggttgcgctcgaaagtgacaaaacttttattccacatttggagaaactaatggcagatcccggaaatccagacttgtatcatgtattaagtgttatctggcaattagcttgtgagattaaggttctgcacatggagccttggtcatcatttgatatatacacccggaaagggccgctggaaaacccaaagcgtagggaattattagaccaattacaacaaaagctgtatcttattcaaatgattcctcgtcaaaatttatttaccaagaacttaacacctatgaactataatatattttttcacttgttaaagcactgttttgggaggcgcagcgccactgtaatagaccacttacgttcattgactccacttgatgcgagagatatattgatgcaaataggaaaacaggaggatgagaaagtagttaacatgcaccctcaagacttcaaaacactttttgaaactatagagcgttccaaagattgtgcttataaatggctgtatgatgaaaccctggaagataggtagcaactagactgtcgtttttggtggagcggttcatttatttggaaactatgacatgaaaaccaaatttgaaaactcacatcctttcagcagaaggtaactgttcttgtcttgcacaagccaggcagatcatttctcctaagctgatatcattggcttattggatgaaacagtgtctgctattttattcacaattgaataaaatgaaaacttcaattaattgtggatttgatcagattgaattcgttttgtttcagattcctatttaaatatttcacttgtactgttgctgatttttgcatcttcttgaagagcaagagtctgtacattattaagcttagaaagtaagcaaaactgatttactggtttgcctttcagtttgttgaaatgtattgtcaagtactgtacaatgaaattgtttaaattttaatatgatttaagctttttagaaattaaaatattttaaataaga

SEQ ID NO: 298668 - DNA, 1906 bp, Homo sapiens
agcggagtgtttacttccgcttgacctggcccggacgccagaaaatgttccacgtgggataccctgcgtggggttcactgtagtagctgcactaggtgattcttggagcgggcctgagagacaaggacatgtggatcccagtggtcgggcttcctcggcggctgaggctctccgccttggcgggcgctggtcgcttttgcattttagggtctgaagcggcgacgcgaaagcatttgccggcgaggaaccactgtgggctctctgactcctctccgcagctgtggcccgaaccggatttcaggaatccgccaaggaaggcgtctaaggccagcttagactttaagcgttacgtaaccgatcggagattggctgagaccctggcgcaaatctatttgggaaaaccaagtagacctccacacctactgctggagtgcaatccaggtcctggaatcctgactcaggcattacttgaagctggtgccaaagtggttgcgctcgaaagtgacaaaacttttattccacatttggagtccttaggaaaaaatctggatggaaaactacgagtgattcactgtgacttctttaaactagatcctagaagtggtggagtaataaaaccacctgctatgtcttctcgagggctctttaagaatttgggaatagaagcagttccttggacagcagacatccctttaaaagtagttggaatgttcccaagtagaggtgagaaaagggcactttggaaactcgcatatgacttgtattcctgtacttctatatataaatttggacgaatagaagtaaatatgtttattggtgaaaaagaattccagaaactaatggcagatcccggaaatccagacttgtatcatgtattaagtgttatctggcaattagcttgtgagattaaggttctgcacatggagccttggtcatcatttgatatatacacccggaaagggccgctggaaaacccaaagcgtagggaattattagaccaattacaacaaaagctgtatcttattcaaatgattcctcgtcaaaatttatttaccaagaacttaacacctatgaactataatatattttttcacttgttaaagcactgttttgggaggcgcagcgccactgtaatagaccacttacgttcattgactccacttgatgcgagagatatattgatgcaaataggaaaacaggaggatgagaaagtagttaacatgcaccctcaagacttcaaaacactttttgaaactatagagcgttccaaagattgtgcttataaatggctgtatgatgaaaccctggaagataggtagcaactagactgtcgtttttggtggagcggttcatttatttggaaactatgacatgaaaaccaaatttgaaaactcacatcctttcagcagaaggtaactgttcttgtcttgcacaagccaggcagatcatttctcctaagctgatatcattggcttattggatgaaacagtgtctgctattttattcacaattgaataaaatgaaaacttcaattaattgtggatttgatcagattgaattcgttttgtttcagattcctatttaaatatttcacttgtactgttgctgatttttgcatcttcttgaagagcaagagtctgtacattattaagcttagaaagtaagcaaaactgatttactggttgcttcaagtgtgaatgttgtcagtactgtacatgaatgttaattatatgattagtttgaataatttatagacaaaaaaaaaagaaggaaaatgaaaaaaaaaagggggcggggaaaataataggggacgaaaagtgtaaaaacggaggggtacaaaagggagagtaaggagtgatggagaaacgggaaaaacaaagaagggaagttgcgttctctgttgttt

SEQ ID NO: 298669 - DNA, 1083 bp, Homo sapiens
agcggagtgtttacttccgcttgacctggcccggacgccagaaaatgttccacgtgggataccctgcgtggggttcactgtagtagctgcactaggtgattcttggagcgggcctgagagacaaggacatgtggatcccagtggtcgggcttcctcggcggctgaggctctccgccttggcgggcgctggtcgcttttgcattttagggtctgaagcggcgacgcgaaagcatttgccggcgaggaaccactgtgggctctctgactcctctccgcagctgtggcccgaaccggatttcaggaatccgccaaggaaggcgtctaaggccagcttagactttaagcgttacgtaaccgatcggagattggctgagaccctggcgcaaatctatttgggaaaaccaagtagacctccacacctactgctggagtgcaatccaggtcctggaatcctgactcaggcattacttgaagctggtgccaaagtggttgcgctcgaaagtgacaaaacttttattccacatttggagtccttaggaaaaaatctggatggaaaactacgagtgattcactgtgacttctttaaactagatcctagaagtggtggagtaataaaaccacctgctatgtcttctcgagggctctttaagaatttgggaatagaagcagttccttggacagcagacatccctttaaaagtagttggaatgttcccaagtagaggtgagaaaagggcactttggaaactcgcatatgacttgtattcctgtacttctatatataaatttggacgaatagaagtaaatatgtttattggtgaaaaagaattccaggtatgttattaacaaatacctattttttgttctgagtctgtaatttttctctgagtactcttaatctgtgcgattttaatttagggctcgtgacatttgagggtctaagattgtttttaaattctgcagagcagtcttatgctcaggttgctttttcagtgtacagttgagtggttttaactgcattcccattgtacagccattaccatcatctgtctccaaaacttttcatcatcccataccaaaactc

SEQ ID NO: 298670 - DNA, 1170 bp, Homo sapiens
ggccggcccactgggttgtgctttctgccgtacgtcccttcccatgaggatgagatgacccatctgttgcatcccggctgctgataaaacaagaccctcggagccaagaaacaacactgagttccagatttcggaaggttcacgagtgttgccgacacgccctcccaactgcagacatcctccctggaggacctgctgtgctcacatgcccccctgtccagcgaggacgacacctccccgggctgtgcagccccctcccaggcacccttcaaggccttcctcagtcccccagagccacatagccaccgaggcaccgacaggaagctgtccccgctcctgagccccttgcaagactcactggtggacaagaccctgctggagcccagggagatggtccggcctaagaaggtgtgtttctcggagagcagcctgcccaccggggacaggaccaggaggagctactacctcaatgagatccagagcttcgcgggcgccgagaaggacgcgcgcgtggtgggcgagatcgccttccagctggaccgccgcatcctggcctacgtgttcccgggcgtgacgcggctctacggcttcacggtggccaacatccccgagaagatcgagcagacctccaccaagtctctggacggctccgtggacgagaggaagctgcgcgagctgacgcagcgctacctggccctgagcgcgcgcctggagaagctgggctacagccgcgacgtgcacccggcgttcagcgagttcctcatcaacacctacggaatcctgaagcagcggcccgacctgcgcgccaaccccctgcacagcagcccggccgcgctgcgcaagctggtcatcgacgtggtgccccccaagttcctgggcgactcgctgctgctgctcaactgcctgtgcgagctctccaaggaggacggcaagcccctcttcgcctggtgagccgccccgcgcccgccgccttgcctgcagtaaacgcgtttgttccaacccggggccgcggtgcctcctgcgcgtccccccggaggggaaagggccgcgtcccccgcgcgcgaggccagagaaggccccgctcccaccggtgctgggccccgaccgcagcccgccgctgcccgcacctgcggagtgcttctcacccctcattaaaatcatccgtttgca

SEQ ID NO: 298671 - DNA, 2861 bp, Homo sapiens
ggccggcccactgggttgtgctttctgccgtacgtcccttcccatgaggatgagatgacccatctgttgcatcccggctgctgataaaacaagaccctcggagccaagaaacaacactgagttccagatttcggaaggttcacgagtgttgccgacacgccctcccaactgcagacatcctccctggaggacctgctgtgctcacatgcccccctgtccagcgaggacgacacctccccgggctgtgcagccccctcccaggcacccttcaaggccttcctcagtcccccagagccacatagccaccgaggcaccgacaggaagctgtccccgctcctgagccccttgcaagactcactggtggacaagaccctgctggagcccagggagatggtccggcctaagaaggtgtgtttctcggagagcagcctgcccaccggggacaggaccaggaggagctactacctcaatgagatccagagcttcgcgggcgccgagaaggacgcgcgcgtggtgggcgagatcgccttccagctggaccgccgcatcctggcctacgtgttcccgggcgtgacgcggctctacggcttcacggtggccaacatccccgagaagatcgagcagacctccaccaagtctctggacggctccgtggacgagaggaagctgcgcgagctgacgcagcgctacctggccctgagcgcgcgcctggagaagctgggctacagccgcgacgtgcacccggcgttcagcgagttcctcatcaacacctacggaatcctgaagcagcggcccgacctgcgcgccaaccccctgcacagcagcccggccgcgctgcgcaagctggtcatcgacgtggtgccccccaagttcctgggcgactcgctgctgctgctcaactgcctgtgcgagctctccaaggaggacggcaagcccctcttcgcctggtgagccgccccgcgcccgccgccttgcctgcagtaaacgcgtttgttccaacccggggccgcggtgcctcctgcgcgtccccccggaggggaaagggccgcgtcccccgcgcgcgaggccagagaaggccccgctcccaccggtgctgggccccgaccgcagcccgccgctgcccgcacctgcggagtgcttctcacccctcattaaaatcatccgtttgcaaaaaaaaaaaaaaaaaactcgagactagttctctccctgccgtcgcgtttgcacctcgctgctccagcctctggggcgcattccaaccttccagcctgcgacctgcggagaaaaaaaattacttattttcttgccccatacataccttgaggcgagcaaaaaaattaaattttaaccatgagggaaatcgtgcacatccaggctggtcagtgtggcaaccagatcggtgccaagttctgggaggtgatcagtgatgaacatggcatcgaccccaccggcacctaccacggggacagcgacctgcagctggaccgcatctctgtgtactacaatgaagccacaggtggcaaatatgttcctcgtgccatcctggtggatctagaacctgggaccatggactctgttcgctcaggtccttttggccagatctttagaccagacaactttgtatttggtcagtctggggcaggtaacaactgggccaaaggccactacacagagggcgccgagctggttgattctgtcctggatgtggtacggaaggaggcagagagctgtgactgcctgcagggcttccagctgacccactcactgggcgggggcacaggctctggaatgggcactctccttatcagcaagatccgagaagaataccctgatcgcatcatgaataccttcagtgtggtgccttcacccaaagtgtctgacaccgtggtcgagccctacaatgccaccctctccgtccatcagttggtagagaatactgatgagacctattgcattgacaacgaggccctctatgatatctgcttccgcactctgaagctgaccacaccaacctacggggatctgaaccaccttgtctcagccaccatgagtggtgtcaccacctgcctccgtttccctggccagctcaatgctgacctccgcaagttggcagtcaacatggtccccttcccacgtctccatttctttatgcctggctttgcccctctcaccagccgtggaagccagcagtatcgagctctcacagtgccggaactcacccagcaggtcttcgatgccaagaacatgatggctgcctgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacatcccacctcgtggcctcaagatggcagtcaccttcattggcaatagcacagccatccaggagctcttcaagcgcatctcggagcagttcactgccatgttccgccggaaggccttcctccactggtacacaggcgagggcatggacgagatggagttcaccgaggctgagagcaacatgaacgacctcgtctctgagtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctgcctctatcttgttttttgttttttcttctgggggggggtctagaacagtgcctggcacatagtaggcgctcaataaatacttgtttgtt

SEQ ID NO: 298672 - DNA, 1316 bp, Homo sapiens
ggccggcccactgggttgtgctttctgccgtacgtcccttcccatgaggatgagatgacccatctgttgcatcccggctgctgataaaacaagaccctcggagccaagaaacaacactgagttccagatttcggaaggttcacgagtgttgccgacacgccctcccaactgcagacatcctccctggaggacctgctgtgctcacatgcccccctgtccagcgaggacgacacctccccgggctgtgcagccccctcccaggcacccttcaaggccttcctcagtcccccagagccacatagccaccgaggcaccgacaggaagctgtccccgctcctgagccccttgcaagactcactggtggacaagaccctgctggagcccagggagatggtccggcctaagaagagatccagagcttcgcgggcgccgagaaggacgcgcgcgtggtgggcgagatcgccttccagctggaccgccgcatcctggcctacgtgttcccgggcgtgacgcggctctacggcttcacggtggccaacatccccgagaagatcgagcaggtgcgccccgtggggagggcgcggccaggagggtgcggggcgctcggtccgtccctgtgcggcccccagatcttggctcctggccgggcactgtccgcaggaggggaccccggggacccaggcgggcggggcagggatcggccctgggcctggaagtccccgtccgagggccccgagccccccacccccatccatgcgctgcgcccgcagacctccaccaagtctctggacggctccgtggacgagaggaagctgcgcgagctgacgcagcgctacctggccctgagcgcgcgcctggagaagctgggctacagccgcgacgtgcacccggcgttcagcgagttcctcatcaacacctacggaatcctgaagcagcggcccgacctgcgcgccaaccccctgcacagcagcccggccgcgctgcgcaagctggtcatcgacgtggtgccccccaagttcctgggcgactcgctgctgctgctcaactgcctgtgcgagctctccaaggaggacggcaagcccctcttcgcctggtgagccgccccgcgcccgccgccttgcctgcagtaaacgcgtttgttccaacccggggccgcggtgcctcctgcgcgtccccccggaggggaaagggccgcgtcccccgcgcgcgaggccagagaaggccccgctcccaccggtgctgggccccgaccgcagcccgccgctgcccgcacctgcggagtgcttctcacccctcattaaaatcatccgtttgca

SEQ ID NO: 298673 - DNA, 570 bp, Homo sapiens
ttctgccgtacgtcccttcccatgaggatgagatgacccatctgttgcatcccggctgctgataaaacaagaccctcggagccaagaaacaacactgaggtgatttactttcccaagtaattgaagcagggagtcagggtgggtttcaagtcggtcgcactgactgaggacagacgcctgctctagcagggccccatgagccgcagccctgtgtgacggcccgaggggccgtggccatgggttgggggcgtcctcagttacgtgcaggcaggagcagtgcagtcaggaacaattggtgtcttagacacgggcgctcgtggtctgaggggtggacatgcactgctggacccttctcatcagggagtgaggtcagtaggtggcctccagcccagccctcagggccacccagtgctccaaagcatgtgggggccatcgtggggctgcctcaggctggtctccccaccctaggctggtctcccccgcaagactggtctcctcccccaggctggtctcccccacaaggctggtctcctcccccaggctggtctcctcaccaggctggtctcctcc

SEQ ID NO: 298674 - DNA, 2969 bp, Homo sapiens
tccttctgaaggacctcatccttcctcacagggggatgaccaagaaatcattttgtggctggttctggccacgccctttggactgtgctgttccgccatatttcaatgccaaatgaaccacattgacatgacctggaccatagggcttcctatcctgggctcagctgcccctgtctgaagggtcttggcttgattgcagaaggacaacctccgcacccacctaaagacatgtatatgtcttgggatcccagagattgggtccttgggcctggcttcttaagagttttgatgatgctgggaaaagtgactgcgattctgaagaaccgctgccttgcaaggtcaaggacattcagtggttgctggggtccgcagactactgccacccactcaccatcaactctgttagcccaattgccctgctgaacaactgcctgaatacaggctttaggttcccctggactccagccaaggctgttcaggtgggaccatggtgctctttaagcgtgatcggagggaagacacacagcagggccaccattccatgaatgggaggtgtacagatcactttctctttgtgctcagttctcttctgtctccagcagctatattggtaagactagtacctgccagggagaggtgcccccaagtgaaggggtacagtggcacctgggaaaaggcacctggaaggtttccatgtggcccagcccagcatggaagcagggtgggaactctgctgtgtcgccagcgctcactctactcgagtggctttttgagagccctgccatgtctgtgtcaggcctgtgctgcttcacatcctacagctgcctgggaaaggccggccacgctccctgtccacacactccctgtccacacactccctgtccacaactgcagccgggccctctgcctatgggcacccaatccaagcagctgctccacctttgtttggcatggtgatttgtgttttttctcttggtgcttatgtgtgtgggcttgggacgagtgctggtatgcacttaggaccttcttgatagctccctgcactttggaacacggagcagatgagagagggtcaggggcttgccctccaccttggacttggaagaagcccacattggagaggtgaggaccccatggtggctctagtggaagatacgttagtctccagctaaggaggatgaggcgcagccccagagggagacctcagtgataggggatcaggctacgaaagtgggggaagggagatgctttgtacatattttggggttataatttctctaaattttaggagaacgggtattgattgataaaagggacaggcagtagtgttcaacagtgcatgtgaaggaaagttctgttttccatggttttgacattctttggactgtattgtgactgctgtctggtccacatggtacccctttggtaagtaggcttcagtgcataccagggtatcactggagatgggagttagtgaaggggtgactccctggcctagtatagtgtgaccctgggacaacttaatgtcctaaagcattttggtgacttctagggaatagcaaagacctatttcattgtccccaggtaagtatgtgatgagcaatgaggaggagtggaaaacaaaacccagaaagtgcggcaggaccagcctgacgcacacgctcctgttgtcatggcagacagccgccttgggtgggcaccaccctggcagttccagcctgtaggggagtgaagggacatggctgagctgggcatgtgctgaggttgacttagggaacaagccctgggattggacaaaagggcccatgctgcagccactgactgggggcagagctctgggtggaagagggaagagatcctaatggaggcgcctccatctgcaaccacagttgtaaggctcatggcacctctgcttggaaagcactggtttagggacttagagaggtaggcacaaggtgggtctcctgggtaagggaagcaagagcagactgttgggccaacaggagaagctccccagagtaggggagaaggttggggtgtagggccttccacgtggaacagacagcccctgtgtctctgtctcttggggacctgagtttgggtggggtggcagttggcacagcgcagatgcggtagagatgggaggaaacccagctcctcacttccgtgtgcctcatgcctttgcatacacaagcaccaaacctactaggtcttctcattacccatgtaaaccacatgttagataaatttttgcaagtagaggaaagaaggaaataaaacatcacattttggtgtctctcaggctttcccccccaactatggtttctttgctttttgttttaacatagttttgttgctgtcttctgtaatgatacagttttgtgcagctgttttcacttagcatatcgtgggcatctccccttatgattactaaatattttattttggagtggctgtgtactctcccattgactagatggaccattgtgccagttgccaatcactaatgctgttactaacttttcagttataaattgatgaatatctttgtgcacaggctgtttcccaatgtcaagttattagggtagactccaggaggtgggattcttcaactaaagaatatgaaaacctttgaggcttttactacatattgacaaaatggtttccggaaatatttgtatccccttacactgccaccagcaaggataaacatgtccatcttgcccgtattgggaattatcatctggctaaatatttgctaatttgataatgaaaaaatagcatcgtgtttcagttggcatttcactgacttctagcacggttgaacatctttcatgtggagcgattgtatttcctcctttgtggattgtcagtgtcctttgctctatcttctggggtcagataaatttgtatgagctcggtatatattaaagatattaacctggtgtgtgtcatatttgctacagctg

SEQ ID NO: 298675 - DNA, 2983 bp, Homo sapiens
tccttctgaaggacctcatccttcctcacagggggatgaccaagaaatcattttgtggctggttctggccacgccctttggactgtgctgttccgccatatttcaatgccaaatgaaccacattgacatgacctggaccatagggcttcctatcctgggctcagctgcccctgtctgaagggtcttggcttgattgcagaaggacaacctccgcacccacctaaagacatgtatatgtcttgggatcccagagattgggtccttgggcctggcttcttaagagttttgatgatgctgggaaaagtgactgcgattctgaagaaccgctgccttgcaaggtcaaggacattcagtggttgctggggtccgcagactactgccacccactcaccatcaactctgttagcccaattgccctgctgaacaactgcctgaatacaggctttaggttcccctggactccagccaaggctgttcaggtgggaccatggtgctctttaagcgtgatcggagggaagacacacagcagggccaccattccatgaatgggaggtgtacagatcactttctctttgtgctcagttctcttctgtctccagcagctatattggtaagactagtacctgccagggagaggtgcccccaagtgaaggggtacagtggcacctgggaaaaggcacctggaaggtttccatgtggcccagcccagcatggaagcagggtgggaactctgctgtgtcgccagcgctcactctactcgagtggctttttgagagccctgccatgtctgtgtcaggcctgtgctgcttcacatcctacagctgcctgggaaaggccggccacgctccctgtccacacctccctgtccacacactccctgtccacacactccctgtccacaactgcagccgggccctctgcctatgggcacccaatccaagcagctgctccacctttgtttggcatggtgatttgtgttttttctcttggtgcttatgtgtgtgggcttgggacgagtgctggtatgcacttaggaccttcttgatagctccctgcactttggaacacggagcagatgagagagggtcaggggcttgccctccaccttggacttggaagaagcccacattggagaggtgaggaccccatggtggctctagtggaagatacgttagtctccagctaaggaggatgaggcgcagccccagagggagacctcagtgataggggatcaggctacgaaagtgggggaagggagatgctttgtacatattttggggttataatttctctaaattttaggagaacgggtattgattgataaaagggacaggcagtagtgttcaacagtgcatgtgaaggaaagttctgttttccatggttttgacattctttggactgtattgtgactgctgtctggtccacatggtacccctttggtaagtaggcttcagtgcataccagggtatcactggagatgggagttagtgaaggggtgactccctggcctagtatagtgtgaccctgggacaacttaatgtcctaaagcattttggtgacttctagggaatagcaaagacctatttcattgtccccaggtaagtatgtgatgagcaatgaggaggagtggaaaacaaaacccagaaagtgcggcaggaccagcctgacgcacacgctcctgttgtcatggcagacagccgccttgggtgggcaccaccctggcagttccagcctgtaggggagtgaagggacatggctgagctgggcatgtgctgaggttgacttagggaacaagccctgggattggacaaaagggcccatgctgcagccactgactgggggcagagctctgggtggaagagggaagagatcctaatggaggcgcctccatctgcaaccacagttgtaaggctcatggcacctctgcttggaaagcactggtttagggacttagagaggtaggcacaaggtgggtctcctgggtaagggaagcaagagcagactgttgggccaacaggagaagctccccagagtaggggagaaggttggggtgtagggccttccacgtggaacagacagcccctgtgtctctgtctcttggggacctgagtttgggtggggtggcagttggcacagcgcagatgcggtagagatgggaggaaacccagctcctcacttccgtgtgcctcatgcctttgcatacacaagcaccaaacctactaggtcttctcattacccatgtaaaccacatgttagataaatttttgcaagtagaggaaagaaggaaataaaacatcacattttggtgtctctcaggctttcccccccaactatggtttctttgctttttgttttaacatagttttgttgctgtcttctgtaatgatacagttttgtgcagctgttttcacttagcatatcgtgggcatctccccttatgattactaaatattttattttggagtggctgtgtactctcccattgactagatggaccattgtgccagttgccaatcactaatgctgttactaacttttcagttataaattgatgaatatctttgtgcacaggctgtttcccaatgtcaagttattagggtagactccaggaggtgggattcttcaactaaagaatatgaaaacctttgaggcttttactacatattgacaaaatggtttccggaaatatttgtatccccttacactgccaccagcaaggataaacatgtccatcttgcccgtattgggaattatcatctggctaaatatttgctaatttgataatgaaaaaatagcatcgtgtttcagttggcatttcactgacttctagcacggttgaacatctttcatgtggagcgattgtatttcctcctttgtggattgtcagtgtcctttgctctatcttctggggtcagataaatttgtatgagctcggtatatattaaagatattaacctggtgtgtgtcatatttgctacagctg

SEQ ID NO: 298676 - DNA, 1358 bp, Homo sapiens
cgggctgtcatgctcgcacatgtgccattaattgacaagaatgctgctcaagttggctgatcaagagataggcagtgcaaaggaacaggatttgagacagcccaggtttcctcttcaagtaggtctaaaacatttttttttctcattgacttccttcctgttctaactgccagtactcagaagtcagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298677 - DNA, 926 bp, Homo sapiens
aattcgcggccgcgtcgactacggctgcgagaagacgcagaaggggggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctgtcaagtggccttacagcagattcttggggtttcccccgcacaggggccaacagagggacggtaccacggcgcgtgcaaggcatggcctcagagataatcgtctgaaggagacacacagcgccgtacatgggggagcggcgaagacgtgctcacgtccaggctg

SEQ ID NO: 298678 - DNA, 642 bp, Homo sapiens
aattcgcggccgcgtcgactacggctgcgagaagacgcagaaggggggagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactgagatctggaagccctcatcaaagggaacagggatattgcgtcagccctgaaatacgtttagcacacctacagcactgggcgtgaaagtgcataaagcaccatttatgcgttgccacctatggacccccgcactgagtgagaaagcgcttcctccattccagttgagcgagcccccctaacggtcacccctgccccgaggccccgttccattaacaagtccctcttccaccgactctgccaacgttaacctcactctttcttagcaatag

SEQ ID NO: 298679 - DNA, 1269 bp, Homo sapiens
  misc_feature (26)..(26): n is a, c, g, or t
  misc_feature (28)..(28): n is a, c, g, or t
gcaggattcggcacgagcggacaganangtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaaaagtaagtatcctgccttgtgtgtttttgtaaagtttaaatcttttctttaatcagtgactacatttcttgcatgatcatgttgaggtactttttgtttgtttctcccctagtacccccaagctgggtctggaatgtcctcttcccagccctgagggctacctgttgagacccacgtttgcctcctgtcttttcctagccaggacttcttaaactcttcattatctcttaagccaatgggatccctctgtgaactccaaacacatcctcgaggcacacactgctttgtgttgtaccacctgtgtcatttcttcttcatagaatataagcacctcaatctagggtgaaattgtacatctctcctttccaatatttcacacaaaactttgtaaatagcatatagttcatgaatatatattgaaaagtggacaaacaagtgaatcaaccaataggaaaagaaaatgggacagggcctcagctctaattgctcaaggattatataaatccaggaagtgtgatctttgctaaagaactggaaattacaattatagttgtggaacaggtaaccaggaaagaggaaactaaataagaaataaactgacatctaatatatcccaatgagccatatatcccaatgagcagccaaaatcacaagaaaaataactttgactttgaaaacaaataagttagaaatgcagtgtttgcacttcgtggtttatgtttgctttggtggcctctcattcccacttagcctcagtctccagggcctgggctccaccaaggaagactccatctgctctctctatttgcacactgggaacttttttccccaaggtacaggatatgattcagggtttatggatgacctccctac

SEQ ID NO: 298680 - DNA, 1248 bp, Homo sapiens
tccggacggaaacggtaggcatatgggttctgatcgaaacaagaaatagacgatccacacaacaaacaccaagacagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298681 - DNA, 1816 bp, Homo sapiens
  misc_feature (1457)..(1457): n is a, c, g, or t
  misc_feature (1464)..(1464): n is a, c, g, or t
  misc_feature (1475)..(1475): n is a, c, g, or t
  misc_feature (1477)..(1477): n is a, c, g, or t
  misc_feature (1479)..(1479): n is a, c, g, or t
  misc_feature (1486)..(1486): n is a, c, g, or t
  misc_feature (1501)..(1502): n is a, c, g, or t
  misc_feature (1511)..(1511): n is a, c, g, or t
  misc_feature (1514)..(1514): n is a, c, g, or t
  misc_feature (1517)..(1517): n is a, c, g, or t
  misc_feature (1523)..(1523): n is a, c, g, or t
  misc_feature (1537)..(1537): n is a, c, g, or t
  misc_feature (1552)..(1552): n is a, c, g, or t
  misc_feature (1556)..(1556): n is a, c, g, or t
  misc_feature (1559)..(1559): n is a, c, g, or t
  misc_feature (1563)..(1563): n is a, c, g, or t
  misc_feature (1570)..(1570): n is a, c, g, or t
  misc_feature (1585)..(1585): n is a, c, g, or t
  misc_feature (1588)..(1589): n is a, c, g, or t
cgggctgtcatgctcgcacatgtgccattaattgacaagaatgctgctcaagttggctgatcaagagataggcagtgcaaaggaacaggatttgagacagcccaggtttcctcttcaagtaggtctaaaacatttttttttctcattgacttccttcctgttctaactgccagtactcagaagtcagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccttnggggccncctggcccaantnanttttaanttggaaaagtttttnnttggggccnaanttngggctnatttggcaattccnccttaaggggggcgnttanaantaangggccgnggttttaaacggggngannggaaaaaccctggggttccccaacttaatggccttggaaaaaatcccctttttcccaggttggggaaaaacaaaaaagccccacccgatccgccttccacaaaattggcccccctaaatgggaaatggaaattgtaagccttaaatttttgggaaaatcccggtaaaatttgtggaaaacaccccatttttataccaaggggccgaatcgggaaaaccctctataat

SEQ ID NO: 298682 - DNA, 1437 bp, Homo sapiens
  misc_feature (1415)..(1415): n is a, c, g, or t
  misc_feature (1423)..(1423): n is a, c, g, or t
cgggctgtcatgctcgcacatgtgccattaattgacaagaatgctgctcaagttggctgatcaagagataggcagtgcaaaggaacaggatttgagacagcccaggtttcctcttcaagtaggtctaaaacatttttttttctcattgacttccttcctgttctaactgccagtactcagaagtcagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgagaaaaaaaaaaaaaaaaaaaaaaaaaaaaaaaaaaaaaaaaaaaacaaaaaaaaacgancaccaaanacaacaaacacaac

SEQ ID NO: 298683 - DNA, 1393 bp, Homo sapiens
  misc_feature (1371)..(1371): n is a, c, g, or t
  misc_feature (1379)..(1379): n is a, c, g, or t
cgggctgtcatgctcgcacatgtgccattaattgacaagaatgctgctcaagttggctgatcaagagataggcagtgcaaaggaacaggatttgagacagcccaggtttcctcttcaagtaggtctaaaacatttttttttctcattgacttccttcctgttctaactgccagtactcagaagtcagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgagaaaaaaaaaacgancaccaaanacaacaaacacaac

SEQ ID NO: 298684 - DNA, 1323 bp, Homo sapiens
cgggctgtcatgctcgcacatgtgccattaattgacaagaatgctgctcaagttggctgatcaagagataggcagtgcaaaggaacaggatttgagacagcccaggtttcctcttcaagtaggtctaaaacatttttttttctcattgacttccttcctgttctaactgccagtactcagaagtcagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgcttctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298685 - DNA, 1070 bp, Homo sapiens
cgggctgtcatgctcgcacatgtgccattaattgacaagaatgctgctcaagttggctgatcaagagataggcagtgcaaaggaacaggatttgagacagcccaggtttcctcttcaagtaggtctaaaacatttttttttctcattgacttccttcctgttctaactgccagtactcagaagtcagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgacaacaagtccttcttcaccgacgataacaagcaagaccacctcagctgggagtggaacctgtcgattaagaaggagtggacagaatgaatgcatccacccctttccccacc

SEQ ID NO: 298686 - DNA, 1195 bp, Homo sapiens
aattcgcggccgcgtcgactacggctgcgagaagacgcagaaggggggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298687 - DNA, 1406 bp, Homo sapiens
tccggacggaaacggtaggcatatgggttctgatcgaaacaagaaatagacgatccacacaacaaacaccaagacagagttgagagacagaggcaccccggacagagacgtgaagcactgaataggatgaaactggggcccagtgaggttaagcaacttgcaggaggtaacgcaggaaccgagttgcgctgaaacatcgttatctgacacttccctgctttgttaaagctgtctctgcagagcttgcaaagaagcatttacctctgcttgtgcacctccagaaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298688 - DNA, 1243 bp, Homo sapiens
cgggctgtcatgctcgcacatgtgccattaattgacaagaatgctgctcaagttggctgatcaagagataggcagtgcaaaggaacaggatttgagacagcccaggtttcctcttcaaaaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298689 - DNA, 1226 bp, Homo sapiens
ggctggctggatttggaggactgtgataactcctacagctttttgactgggcttttgcttcatttgttcaggagtctttgtgccatgttgcttcactcgtaaaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298690 - DNA, 1147 bp, Homo sapiens
gggctgtcattctgtctcccagaaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298691 - DNA, 1238 bp, Homo sapiens
tcagaagggctctgagaacacgcaccgggagtgcctggaggggtttcctgcaaagtaggagcaggcacctggccaggcttggaagaaaaagactgtagatccaaaatgatacgaaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298692 - DNA, 1167 bp, Homo sapiens
  misc_feature (26)..(26): n is a, c, g, or t
  misc_feature (28)..(28): n is a, c, g, or t
gcaggattcggcacgagcggacaganangtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298693 - DNA, 1075 bp, Homo sapiens
  misc_feature (952)..(952): n is a, c, g, or t
  misc_feature (954)..(954): n is a, c, g, or t
  misc_feature (973)..(973): n is a, c, g, or t
  misc_feature (980)..(980): n is a, c, g, or t
cgggctgtcatgctcgcacatgtgccattaattgacaagaatgctgctcaagttggctgatcaagagataggcagtgcaaaggaacaggatttgagacagcccaggtttcctcttcaagtaggtctaaaacatttttttttctcattgacttccttcctgttctaactgccagtactcagaagtcagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaaaggggtcagaacactggctcctctccgccaagtgggtcctcttaacaggcacttcttttgngngtttcccccggccaggccnaaaaggnaacgggtccaccggccccggttcagggagatggccgaaaaatatgcggccacaagaagaggaacaggcggggatatatgtggccccatagtaaac

SEQ ID NO: 298694 - DNA, 1035 bp, Homo sapiens
cgggctgtcatgctcgcacatgtgccattaattgacaagaatgctgctcaagttggctgatcaagagataggcagtgcaaaggaacaggatttgagacagcccaggtttcctcttcaagtaggtctaaaacatttttttttctcattgacttccttcctgttctaactgccagtactcagaagtcagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaatctctagggggggttgaccctgccttctcctggcacgtgggactcttaaatggccattcctatggtggcttccccttgatcagggctaaaaaggtaacggttacacagtcctgatacgggaatcatcacggaaaaatacgtcaa

SEQ ID NO: 298695 - DNA, 996 bp, Homo sapiens
  misc_feature (893)..(893): n is a, c, g, or t
cgggctgtcatgctcgcacatgtgccattaattgacaagaatgctgctcaagttggctgatcaagagataggcagtgcaaaggaacaggatttgagacagcccaggtttcctcttcaagtaggtctaaaacatttttttttctcattgacttccttcctgttctaactgccagtactcagaagtcagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaatnttttagggggggggaaccccgtccttcttcttgttaaaaatgggggcttttaaaaatgcgcattttttttagggttttttcaccccgcctcgggggcttggag

SEQ ID NO: 298696 - DNA, 1321 bp, Homo sapiens
cgggctgtcatgctcgcacatgtgccattaattgacaagaatgctgctcaagttggctgatcaagagataggcagtgcaaaggaacaggatttgagacagcccaggtttcctcttcaagtaggtctaaaacatttttttttctcattgacttccttcctgttctaactgccagtactcagaagtcagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaaagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298697 - DNA, 1018 bp, Homo sapiens
  misc_feature (13)..(13): n is a, c, g, or t
cggctaggtagcnaggcctgggtggtgcgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298698 - DNA, 1005 bp, Homo sapiens
  misc_feature (17)..(17): n is a, c, g, or t
  misc_feature (21)..(21): n is a, c, g, or t
gcggccgcgtcgacgtncgangcgctgacgaaaagacgacagaaggggctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298699 - DNA, 1275 bp, Homo sapiens
cgggctgtcatgctcgcacatgtgccattaattgacaagaatgctgctcaagttggctgatcaagagataggcagtgcaaaggaacaggatttgagacagcccaggtttcctcttcaagtaggtctaaaacatttttttttctcattgacttccttcctgttctaactgccagtactcagaagtcagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298700 - DNA, 944 bp, Homo sapiens
cacacacacattcagctaccccgacatgctgacatctctccaggagagaaactcacgctctctcaccagaactcagagtcttcctaatattaccaggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298701 - DNA, 1201 bp, Homo sapiens
tcagaagggctctgagaacacgcaccgggagtgcctggaggggtttcctgcaaagtaggagcaggcacctggccaggcttggaagaaaaagactgtagatccaaaatgatacgaaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaaagcacacctacaggactggggtgaaagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298702 - DNA, 1047 bp, Homo sapiens
  misc_feature (237)..(237): n is a, c, g, or t
  misc_feature (239)..(239): n is a, c, g, or t
caacaaagcctgatgacagcatatcaacattgaggcaagacccttggccagcaaaaagatgatagctcactgaaggctcaaatgttagcatttttagcaataaagtgttttttaattaatatacttttttttagacataatgctattgcatacttaatatactatagtatagtgtaaatataactttttttttttttttttccagcctggacaacaagagcaaaactccatcttaanantgactttaatcactgtaggctgtagtccagattctccagtttgcagtgtgtgtttttcctctatcaggctcttaccctaatgaactcttctttcttcttagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298703 - DNA, 778 bp, Homo sapiens
tcattagggtaataacctgatagaggaaaaacacacactgcaaactggagaatctggactacagcctacagtggataaagcaacatttatggttggcagctatggacctcggcctgaggagtatgagttcctcactccagttgaggaggctcccaagggcatgctggcgcgaggcacgtaccacaacaagtccttcttcaccgacgatgacaagcaagaccacctcagctgggagtggaacctgtcgattaagaaggagtggacagaatgaatgcatccacccctttccccacccttgccacctggaagaattctctcaggcgtgttcagcaccctgtccctcctccctgtccacagctgggtccctcttcaacactgccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298704 - DNA, 825 bp, Homo sapiens
cgggctgtcatgctcgcacatgtgccattaattgacaagaatgctgctcaagttggctgatcaagagataggcagtgcaaaggaacaggatttgagacagcccaggtttcctcttcaagtaggtctaaaacatttttttttctcattgacttccttcctgttctaactgccagtactcagaagtcagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaagtgaacagggatattgtgtcaggcctgaaatacgttcagcacacctacaggactggggtgaaagttaatgcaacacttatgttcgccagctatggcccttgtcctaggagtatgagttccttactccaggagaggtggcttccacggtcatgcttgtaccgcgtcctttaccccaccaagccctagctttacgcgcctacacaccgcaggatcccctcaagttgttgcgcttgccgtc

SEQ ID NO: 298705 - DNA, 1460 bp, Homo sapiens
cgggctgtcatgctcgcacatgtgccattaattgacaagaatgctgctcaagttggctgatcaagagataggcagtgcaaaggaacaggatttgagacagcccaggtttcctcttcaagtaggtctaaaacatttttttttctcattgacttccttcctgttctaactgccagtactcagaagtcagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaaaagtaagtatcctgccttgtgtgtttttgtaaagtttaaatcttttctttaatcagtgactacatttcttgcatgatcatgttgaggtactttttgtttgtttctcccctagtacccccaagctgggtctggaatgtcctcttcccagccctgagggctacctgttgagacccacgtttgcctcctgtcttttcctagccaggacttcttaaactcttcattatctcttaagccaatgggatccctctgtgaactccaaacacatcctcgaggcacacactgctttgtgttgtaccacctgtgtcatttcttcttcatagaatataagcacctcaatctagggtgaaattgtacatctctcctttccaatatttcacacaaaactttgtaaatagcatatagttcatgaatatatattgaaaagtggacaaacaagtgaatcaaccaataggaaaagaaaatgggacagggcctcagctctaattgctcaaggattatataaatccaggaagtgtgatctttgctaaagaactggaaattacaattatagttgtggaacaggtaaccaggaaagaggaaactaaataagaaataaactgacatctaatatatcccaatgagccatatatcccaatgagcagccaaaatcacaagaaaaataactttgactttgaaaacaaataagttagaaatgcagtgtttgcacttcgtggtttatgtttgctttggtggcctctcattcccacttagcctcagtctccagggcctgggctccaccaaggaagactccatctgctctctctatttgcacactgggaacttttttccccaaggtacaggatatgattcagggtttatggatgacctccctac

SEQ ID NO: 298706 - DNA, 498 bp, Homo sapiens
agagtccaaacagtgccagagtccaaacagtgccagagtccaaacagtgccagagtccaaacagtgccagagtccaaacagtgccagagtccaaacagccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298707 - DNA, 664 bp, Homo sapiens
tccggacggaaacggtaggcatatgggttctgatcgaaacaagaaatagacgatccacacaacaaacaccaagacagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298708 - DNA, 581 bp, Homo sapiens
cgggctgtcatgctcgcacatgtgccattaattgacaagaatgctgctcaagttggctgatcaagagataggcagtgcaaaggaacaggatttgagacagcccaggtttcctcttcaagtaggtctaaaacatttttttttctcattgacttccttcctgttctaactgccagtactcagaagtcagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactgagatctgggccctcaggccatggtgacccctttgtagcctttgcccttggtcaccccgatgacgtcgatct

SEQ ID NO: 298709 - DNA, 429 bp, Homo sapiens
tccggacggaaacggtaggcatatgggttctgatcgaaacaagaaatagacgatccacacaacaaacaccaagacagagttgagagacagaggcaccccggacagagacgtgaagcactgaatccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298710 - DNA, 529 bp, Homo sapiens
tccggacggaaacggtaggcatatgggttctgatcgaaacaagaaatagacgatccacacaacaaacaccaagacagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagattctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298711 - DNA, 1020 bp, Homo sapiens
  misc_feature (661)..(661): n is a, c, g, or t
  misc_feature (668)..(668): n is a, c, g, or t
  misc_feature (679)..(679): n is a, c, g, or t
  misc_feature (681)..(681): n is a, c, g, or t
  misc_feature (683)..(683): n is a, c, g, or t
  misc_feature (690)..(690): n is a, c, g, or t
  misc_feature (705)..(706): n is a, c, g, or t
  misc_feature (715)..(715): n is a, c, g, or t
  misc_feature (718)..(718): n is a, c, g, or t
  misc_feature (721)..(721): n is a, c, g, or t
  misc_feature (727)..(727): n is a, c, g, or t
  misc_feature (741)..(741): n is a, c, g, or t
  misc_feature (756)..(756): n is a, c, g, or t
  misc_feature (760)..(760): n is a, c, g, or t
  misc_feature (763)..(763): n is a, c, g, or t
  misc_feature (767)..(767): n is a, c, g, or t
  misc_feature (774)..(774): n is a, c, g, or t
  misc_feature (789)..(789): n is a, c, g, or t
  misc_feature (792)..(793): n is a, c, g, or t
tccggacggaaacggtaggcatatgggttctgatcgaaacaagaaatagacgatccacacaacaaacaccaagacagagttgagagacagaggcaccccggacagagacgtgaagcactgaataaatagatcagaatgactgaaaaagccccagagccacatccacatttccttattgatgcatcttttcccaccctgtcactcaacgtggtccctagaacaagaggcttaaaaccgggctttcacccaacctgctccctctgatcctccatcagggccagatcttccacgtctccatctcagtacacaatcatttaatatttccctgtcttacccctattcaagcaactagaggccagaaaatgggcaaattatcactaacaggtctttgactcaggttccagtagttcattctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccttnggggccncctggcccaantnanttttaanttggaaaagtttttnnttggggccnaanttngggctnatttggcaattccnccttaaggggggcgnttanaantaangggccgnggttttaaacggggngannggaaaaaccctggggttccccaacttaatggccttggaaaaaatcccctttttcccaggttggggaaaaacaaaaaagccccacccgatccgccttccacaaaattggcccccctaaatgggaaatggaaattgtaagccttaaatttttgggaaaatcccggtaaaatttgtggaaaacaccccatttttataccaaggggccgaatcgggaaaaccctctataat

SEQ ID NO: 298712 - DNA, 699 bp, Homo sapiens
tccggacggaaacggtaggcatatgggttctgatcgaaacaagaaatagacgatccacacaacaaacaccaagacagagttgagagacagaggcaccccggacagagacgtgaagcactgaataggatgaaactggggcccagtgaggttaagcaacttgcaggaggtaacgcaggaaccgagttgcgctgaaacatcgttatctgacacttccctgctttgttaaagctgtctctgcagagcttgcaaagaagcatttacctctgcttgtgcacctccagaaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagatccgaaagcccccaatgtcgttgtcacccggctcaccctggtttgtgagagtgccccgggaccaatcaccatggaccttactggagatctggaagccctcaaaaaggaaaccattgtgttaaaggaaggttctgaatatagagtcaaaattcacttcaaaagtgacaaggattattgggtaggcctggaatacgtttagtcttacaggctggggtggtggttgc

SEQ ID NO: 298713 - DNA, 610 bp, Homo sapiens
tccggacggaaacggtaggcatatgggttctgatcgaaacaagaaatagacgatccacacaacaaacaccaagacagagttgagagacagaggcaccccggacagagacgtgaagcactgaataaatagatcagaatgactgaaaaagccccagagccacatgtggaggaggatgacgatgatgagctggacagcaagctcaattataagcctccaccacagaagtccctgaaagagctgcaggaaatggacaaagatgatgagagtctaattaagtacaagaaaacgctgctgggagatggtcctgtggtgacagctagaacaagaggcttaaaaccgggctttcacccaacctgctccctctgatcctccatcagggccagatcttccacgtctccatctcagtacacaatcatttaatatttccctgtcttacccctattcaagcaactagaggccagctaatgcctagattcttttgtggttgttgctggcccaatgagtccctagtcacatcccctgccagagggagttcttcttttgtgagagacactgtaaacgacacaagagaacaagaataaaacaataactgtgtgtgttctggctgaga

SEQ ID NO: 298714 - DNA, 148 bp, Homo sapiens
gcctcaggtaaatctaatgtttatttaggcttggaaaccattgctcttgactttaatcactgtaggctgtagtccagattctccagtttgcagtgtgtgtttttcctctatcaggctcttaccctaatgaactcttctttcttcttag

SEQ ID NO: 298715 - DNA, 149 bp, Homo sapiens
tgctggcccaatgagtccctagtcacatcccctgccagagggagttcttcttttgtgagagacactgtaaacgacacaagagaacaagaataaaacaataactgtgtgtgttctggctgagattctggctgagaccttcatttccctgc

SEQ ID NO: 298716 - DNA, 4170 bp, Homo sapiens
gtgctctgtggatgtgtatagttttaaacccccactgcaagttggagcaaaaggccagttggctaaaacagctgaagaaatggaatagtgttgatgtctgtccatgggaagatggaaatcatggcagtgaattacccaacttaaccaatgctctgcctcagggtgcaaatgccaaccaagattcatcgaacaggccacatcggacagtgttcacccgagccatcgaggcatgcgatctccactggcaggatagccacttgcagcacattatcagcagtgacctatacaccaactactgttaccatgacgacactgaaaactccctcttcgactcccgcgggtggcccctctggcatgaacatgttcctacagcctgtgcaagagtggacgcattacgttctcatgggtaccccagagaagcactgagactagcaatagctattgttaatacattaagacgacagcagcagaaacagttggaaatgttccgaacccaaaaaaaagagctaccccataaaaacataacctcgataaccaatctggagggctgggttggacatcccctggaccctgtgggcactctcttcagtagccttatggaagcctgccgcattgatgatgagaacctctctgggttctcagattttacagagaatatgggacagtgcaagtctctggaataccagcatctacctgcacacaaattcttagaagaaggggaatcctatttaacgctggctgtggaagtagccctgatagggctaggacagcagcgtatcatgcctgatgggctgtacacacaagagaaagtttgccggaatgaggagcagctcatttctaagcttcaggaaattgaattggatgacacactggtgaaaatttttcgcaagcaagcagtcttcctattagaagccggaccatatagtggtttaggtgaaataatccatcgggagagcgttccaatgcacacatttgccaagtatctcttcacctctctcctacctcacgatgctgaattggcatacaaaattgcactgagagcaatgcggttactagtattggaatctactgctccatcaggagacctcacccgcccacaccacattgcatcagttgttcccaaccgctaccctcgctggttcactctaagccacattgagtcccagcagtgtgagctggcatccaccatgctaactgcagccaaaggcgatgttcggaggctggaaacagtattagaatccatccagaaaaacattcactcctcatcacacatcttcaagcttgcccaagatgcatttaaaatagcaactctcatggacagtttgccagacatcactcttttgaaagtgtctctggagctgggcctgcaggttatgcgaatgacactgtcaaccttaaattggcgacggcgggagatggtgaggtggctggtaacgtgtgctactgaagtcggggtttatgccctggacagcatcatgcagacctggtttacactctttactcccaccgaggccacaagtatagttgcaactaccgtgatgtccaacagcaccatcgtccgcctccacctggactgccaccagcaggaaaagctggccagcagcgcccggacacttgcactgcagtgtgccatgaaggatccacagaactgtgccctctctgcgctaaccctttgtgaaaaggatcacatagcttttgagacggcgtaccaaattgttctcgacgctgctacgactggcatgagctatacacagctctttacaatagcacggtacatggagcaccgcgggtaccccatgagggcctacaagctggccaccctggccatgacccatctcaacctgagctacaatcaggacacacaccctgccattaatgatgttttgtgggcctgtgcgcttagccactcccttggtaaaaatgagcttgcagctataatacctctggtggtcaagagtgtcaagtgtgcaacggtactgtcagacattttgcgcagatgcactctgaccactcctggcatggtgggacttcatgggaggaggaactctggtaagctcatgtcactggacaaagcccccttgaggcaactcttggatgccacgatcggggcctacatcaacacaacgcactcacggctcacacacatcagtcctcggcactatagtgagtttatagagttcctcagcaaagcccgagagaccttcttaatggcgcatgatggacacattcagtttacacagtttattgacaacctgaaacaaatctacaaaggcaaaaagaaactgatgatgttggttcgggagaggtttggttgatagatcttgtatgaatggggtggggggtggggatgggagggatggtttgtttttacttgagcctgcctttgtaccctttttaacttaaagaacagagccacaccggtattatatgtgtatagttatattgcgtttgcagactaaattgtcatgttgtgaaagtttgtgtgttttttattttttccctatttctttctttcctttattttattattttttttaattttttttttctggttttgtatgagagagaggttaaaaaggtttggtttacactgagtatatgttgtcaagtggcaaaagtccacatagctctcctgttttctgtatacgttcacagcctcaaaaaaaataattgaaatggctttaaaaaccaaacaaaacacctccatcctgtgataagtacctcgaatggattcagctttactcctttgtaactcatctttacattttcagcatatttaaacaaaccaacaaaatgaaatactaatagtaaaaaggctgacccatgtggctttgcagtgctgttcgtccagaagcatggcacacgatgcttgtgcatgtggaaacttagcgactgtcaacatacattctcagggatttatccaaaaaaattaaaaaaagaatgagagcatttattgtactgtatatatattatagtatatgtctgaatattgaaaatataacattaactaatttataaaaaatattctatgtaatgcaaaatacttgaagctgcagtagcttggttttaaacaaaaacaaaaaaaaaactgagagaaaacctatcagaaggactaaaagtacgccttgcttcagggttggctcaggtggtgaacttcatgctgggcatctatgcagagccaccttttggattgcatggttggactgagatctattgggagaaattatatatgtatatatatttatacaacttatgtatacatatatatatgtatacacacagacacacacacacaccaccaacaaccaccactacaccacacatgcttataacaggcactagaataaagagggacaacaaaatacacagccagagcagcaagccttagcattaagaatatacaatatgccggaattggggttcgtgcctcctagcctaggaaacttaaaagaaatatccttttgacacaaaacacaaaatgttttccaaaacaattgacataatgatacattacgcctttgcagtgagctaataataagctaacctttgtgcacaaataacattatatatattatatatctattctgcataggtattttgactttgtgcaggacagaaagttgtgtaggtatgactgttctacttttcagttttctttttttttaatatattttattttctctagaaattactcaaacaaaagcagccttctatcttgccttgtcttaatgctttaaaataaccaaactggagatctaactaccaaactgttcattatattattaaataccaactttggttacagtatagtgtctttactttagctgatggttctgtaaccttgtgctttttaaagcaatttttatgttttggtgcaaaagttgtccagtgtctcttgttcccttcactagagaacatgcttagaggtatgtttgtaggtatttttgtttagaagaactatttcatgcgctccattttatttattataataggtaaaaagaaaaaaaaaggttgtaattcatcacccatgtaaacatgctcatgaagttgaaagtaattaagatttgatacactgatatcaatttatttatgtaactaaatcactgttttataaacttgttaatgatcaacaatttttgttttgattaaaattagttttttgaaagttga

SEQ ID NO: 298717 - DNA, 4116 bp, Homo sapiens
gtgctctgtggatgtgtatagttttaaacccccactgcaagttggagcaaaaggccagttggctaaaacagctgaagaaatggaatagtgttgatgtctgtccatgggaagatggaaatcatggcagtgaattacccaacttaaccaatgctctgcctcagggtgcaaatgccaaccaagattcatcgaacaggccacatcggacagtgttcacccgagccatcgaggcatgcgatctccactggcaggatagccacttgcagcacattatcagcagtgacctatacaccaactactgttaccatgacgacactgaaaactccctcttcgactcccgcgggtggcccctctggcatgaacatgttcctacagcctgtgcaagagtggacgcattacgttctcatgggtaccccagagaagcactgagactagcaatagctattgttaatacattaagacgacagcagcagaaacagttggaaatgttccgaacccaaaaaaaagagctaccccataaaaacataacctcgataaccaatctggagggctgggttggacatcccctggaccctgtgggcactctcttcagtagccttatggaagcctgccgcattgatgatgagaacctctctgggttctcagattttacagagaatatgggacagtgcaagtctctggaataccagcatctacctgcacacaaattcttagaagaaggggaatcctatttaacgctggctgtggaagtagccctgatagggctaggacagcagcgtatcatgcctgatgggctgtacacacaagagaaagtttgccggaatgaggagcagctcatttctaagcttcaggaaattgaattggatgacacactggtgaaaatttttcgcaagcaagcagtcttcctattagaagccggaccatatagtggtttaggtgaaataatccatcgggagagcgttccaatgcacacatttgccaagtatctcttcacctctctcctacctcacgatgctgaattggcatacaaaattgcactgagagcaatgcggttactagtattggaatctactgctccatcaggagacctcacccgcccacaccacattgcatcagttgttcccaaccgctaccctcgctggttcactctaagccacattgagtcccagcagtgtgagctggcatccaccatgctaactgcagccaaaggcgatgttcggaggctggaaacagtattagaatccatccagaaaaacattcactcctcatcacacatcttcaagcttgcccaagatgcatttaaaatagcaactctcatggacagtttgccagacatcactcttttgaaagtgtctctggagctgggcctgcaggttatgcgaatgacactgtcaaccttaaattggcgacggcgggagatggtgaggtggctggtaacgtgtgctactgaagtcggggtttatgccctggacagcatcatgcagacctggtttacactctttactcccaccgaggccacaagtatagttgcaactaccgtgatgtccaacagcaccatcgtccgcctccacctggactgccaccagcaggaaaagctggccagcagcgcccggacacttgcactgcagtgtgccatgaaggatccacagaactgtgccctctctgcgctaaccctttgtgaaaaggatcacatagcttttgagacggcgtaccaaattgttctcgacgctgctacgactggcatgagctatacacagctctttacaatagcacggtacatggagcaccgcgggtaccccatgagggcctacaagctggccaccctggccatgacccatctcaacctgagctacaatcaggacacacaccctgccattaatgatgttttgtgggcctgtgcgcttagccactcccttggtaaaaatgagcttgcagctataatacctctggtggtcaagagtgtcaagtgtgcaacggtactgtcagacattttgcgcagatgcactctgaccactcctggcatggtgggacttcatgggaggaggaactctggtaagctcatgtcactggacaaagcccccttgaggcaactcttggatgccacgatcggggcctacatcaacacaacgcactcacggctcacacacatcagtcctcggcactatagtgagtttatagagttcctcagcaaagcccgagagaccttcttaatggcgcatgatggacacattcagtttacacagtttattgacaacctgaaacaaatctacaaaggcaaaaagaaactgatgatgttggttcgggagaggtttggttgatagatcttgtatgaatggggtggggggtggggatgggagggatggtttgtttttacttgagcctgcctttgtaccctttttaacttaaagaacagagccacaccggtattatatgtgtatagttatattgcgtttgcagactaaattgtcatgttgtgaaagtttgtgtgttttttattttttccctatttctttctttcctttattttattattttttttaattttttttttctggttttgtatgagagagaggttaaaaaggtttggtttacactgagtatatgttgtcaagtggcaaaagtccacatagctctcctgttttctgtatacgttcacagcctcaaaaaaaataattgaaatggctttaaaaaccaaacaaaacacctccatcctgtgataagtacctcgaatggattcagctttactcctttgtaactcatctttacattttcagcatatttaaacaaaccaacaaaatgaaatactaatagtaaaaaggctgacccatgtggctttgcagtgctgttcgtccagaagcatggcacacgatgcttgtgcatgtggaaacttagcgactgtcaacatacattctcagggatttatccaaaaaaattaaaaaaagaatgagagcatttattgtactgtatatatattatagtatatgtctgaatattgaaaatataacattaactaatttataaaaaatattctatgtaatgcaaaatacttgaagctgcagtagcttggttttaaacaaaaacaaaaaaaaaactgagagaaaacctatcagaaggaatctatgcagagccaccttttggattgcatggttggactgagatctattgggagaaattatatatgtatatatatttatacaacttatgtatacatatatatatgtatacacacagacacacacacacaccaccaacaaccaccactacaccacacatgcttataacaggcactagaataaagagggacaacaaaatacacagccagagcagcaagccttagcattaagaatatacaatatgccggaattggggttcgtgcctcctagcctaggaaacttaaaagaaatatccttttgacacaaaacacaaaatgttttccaaaacaattgacataatgatacattacgcctttgcagtgagctaataataagctaacctttgtgcacaaataacattatatatattatatatctattctgcataggtattttgactttgtgcaggacagaaagttgtgtaggtatgactgttctacttttcagttttctttttttttaatatattttattttctctagaaattactcaaacaaaagcagccttctatcttgccttgtcttaatgctttaaaataaccaaactggagatctaactaccaaactgttcattatattattaaataccaactttggttacagtatagtgtctttactttagctgatggttctgtaaccttgtgctttttaaagcaatttttatgttttggtgcaaaagttgtccagtgtctcttgttcccttcactagagaacatgcttagaggtatgtttgtaggtatttttgtttagaagaactatttcatgcgctccattttatttattataataggtaaaaagaaaaaaaaaggttgtaattcatcacccatgtaaacatgctcatgaagttgaaagtaattaagatttgatacactgatatcaatttatttatgtaactaaatcactgttttataaacttgttaatgatcaacaatttttgttttgattaaaattagttttttgaaagttga

SEQ ID NO: 298718 - DNA, 4146 bp, Homo sapiens
gtgctctgtggatgtgtatagttttaaacccccactgcaagttggagcaaaaggccagttggctaaaacagctgaagaaatggaatagtgttgatgtctgtccatgggaagatggaaatcatggcagtgaattacccaacttaaccaatgctctgcctcagggtgcaaatgccaaccaagattcatcgaacaggccacatcggacagtgttcacccgagccatcgaggcatgcgatctccactggcaggatagccacttgcagcacattatcagcagtgacctatacaccaactactgttaccatgacgacactgaaaactccctcttcgactcccgcgggtggcccctctggcatgaacatgttcctacagcctgtgcaagagtggacgcattacgttctcatgggtaccccagagaagcactgagactagcaatagctattgttaatacattaagacgacagcagcagaaacagttggaaatgttccgaacccaaaaaaaagagctaccccataaaaacataacctcgataaccaatctggagggctgggttggacatcccctggaccctgtgggcactctcttcagtagccttatggaagcctgccgcattgatgatgagaacctctctgggttctcagattttacagagaatatgggacagtgcaagtctctggaataccagcatctacctgcacacaaattcttagaagaaggggaatcctatttaacgctggctgtggaagtagccctgatagggctaggacagcagcgtatcatgcctgatgggctgtacacacaagagaaagtttgccggaatgaggagcagctcatttctaagcttcaggaaattgaattggatgacacactggtgaaaatttttcgcaagcaagcagtcttcctattagaagccggaccatatagtggtttaggtgaaataatccatcgggagagcgttccaatgcacacatttgccaagtatctcttcacctctctcctacctcacgatgctgaattggcatacaaaattgcactgagagcaatgcggttactagtattggaatctactgctccatcaggagacctcacccgcccacaccacattgcatcagttgttcccaaccgctaccctcgctggttcactctaagccacattgagtcccagcagtgtgagctggcatccaccatgctaactgcagccaaaggcgatgttcggaggctggaaacagtattagaatccatccagaaaaacattcactcctcatcacacatcttcaagcttgcccaagatgcatttaaaatagcaactctcatggacagtttgccagacatcactcttttgaaagtgtctctggagctgggcctgcaggttatgcgaatgacactgtcaaccttaaattggcgacggcgggagatggtgaggtggctggtaacgtgtgctactgaagtcggggtttatgccctggacagcatcatgcagacctggtttacactctttactcccaccgaggccacaagtatagttgcaactaccgtgatgtccaacagcaccatcgtccgcctccacctggactgccaccagcaggaaaagctggccagcagcgcccggacacttgcactgcagtgtgccatgaaggatccacagaactgtgccctctctgcgctaaccctttgtgaaaaggatcacatagcttttgagacggcgtaccaaattgttctcgacgctgctacgactggcatgagctatacacagctctttacaatagcacggtacatggagcaccgcgggtaccccatgagggcctacaagctggccaccctggccatgacccatctcaacctgagctacaatcaggacacacaccctgccattaatgatgttttgtgggcctgtgcgcttagccactcccttggtaaaaatgagcttgcagctataatacctctggtggtcaagagtgtcaagtgtgcaacggtactgtcagacattttgcgcagatgcactctgaccactcctggcatggtgggacttcatgggaggaggaactctggtaagctcatgtcactggacaaagcccccttgaggcaactcttggatgccacgatcggggcctacatcaacacaacgcactcacggctcacacacatcagtcctcggcactatagtgagtttatagagttcctcagcaaagcccgagagaccttcttaatggcgcatgatggacacattcagtttacacagtttattgacaacctgaaacaaatctacaaaggcaaaaagaaactgatgatgttggttcgggagaggtttggttgatagatcttgtatgaatggggtggggggtggggatgggagggatggtttgtttttacttgagcctgcctttgtaccctttttaacttaaagaacagagccacaccggtattatatgtgtatagttatattgcgtttgcagactaaattgtcatgttgtgaaagtttgtgtgttttttattttttccctatttctttctttcctttattttattattttttttaattttttttttctggttttgtatgagagagaggttaaaaaggtttggtttacactgagtatatgttgtcaagtggcaaaagtccacatagctctcctgttttctgtatacgttcacagcctcaaaaaaaataattgaaatggctttaaaaaccaaacaaaacacctccatcctgtgataagtacctcgaatggattcagctttactcctttgtaactcatctttacattttcagcatatttaaacaaaccaacaaaatgaaatactaatagtaaaaaggctgacccatgtggctttgcagtgctgttcgtccagaagcatggcacacgatgcttgtgcatgtggaaacttagcgactgtcaacatacattctcagggatttatccaaaaaaattaaaaaaagaatgagagcatttattgtactgtatatatattatagtatatgtctgaatattgaaaatataacattaactaatttataaaaaatattctatgtaatgcaaaatacttgaagctgcagtagcttggttttaagaaaacctatcagaaggactaaaagtacgccttgcttcagggttggctcaggtggtgaacttcatgctgggcatctatgcagagccaccttttggattgcatggttggactgagatctattgggagaaattatatatgtatatatatttatacaacttatgtatacatatatatatgtatacacacagacacacacacacaccaccaacaaccaccactacaccacacatgcttataacaggcactagaataaagagggacaacaaaatacacagccagagcagcaagccttagcattaagaatatacaatatgccggaattggggttcgtgcctcctagcctaggaaacttaaaagaaatatccttttgacacaaaacacaaaatgttttccaaaacaattgacataatgatacattacgcctttgcagtgagctaataataagctaacctttgtgcacaaataacattatatatattatatatctattctgcataggtattttgactttgtgcaggacagaaagttgtgtaggtatgactgttctacttttcagttttctttttttttaatatattttattttctctagaaattactcaaacaaaagcagccttctatcttgccttgtcttaatgctttaaaataaccaaactggagatctaactaccaaactgttcattatattattaaataccaactttggttacagtatagtgtctttactttagctgatggttctgtaaccttgtgctttttaaagcaatttttatgttttggtgcaaaagttgtccagtgtctcttgttcccttcactagagaacatgcttagaggtatgtttgtaggtatttttgtttagaagaactatttcatgcgctccattttatttattataataggtaaaaagaaaaaaaaaggttgtaattcatcacccatgtaaacatgctcatgaagttgaaagtaattaagatttgatacactgatatcaatttatttatgtaactaaatcactgttttataaacttgttaatgatcaacaatttttgttttgattaaaattagttttttgaaagttga

SEQ ID NO: 298719 - DNA, 600 bp, Homo sapiens
tcctttgagtgtatttggcatggaaactagacttgacaattctttttgcaggacgcctttaaccttagctttaatggctgcagaatgtttgtgtttgataaacaagtgagtgaatggtggctcttgggctgacctgcctcttagtacttaggatgtgagagtattcacccttcacccttctgcttagggggtgcaggacaatgtgtgtgggtgtgttcatgaacatctggccacagaatggtatgactgatttattcacatgtgaataatagctgacacggctttctgaattgtggaaaaaacagattcatcgaacaggccacatcggacagtgttcacccgagccatcgaggcatgcgatctccactggcaggatagccacttgcagcacattatcagcagtgacctatacaccaactactgttaccatgacgacactgaaaactccctcttcgactcccgcgggtggcccctctggcatggtaagtgaccaaaccggaaagacatttccatgacttacttctttgtttagtttctatagcattactggaatgggaggtggagaactgaaggattcaatgggagatggatgaatgcttg

SEQ ID NO: 298720 - DNA, 3542 bp, Homo sapiens
agagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatga

SEQ ID NO: 298721 - DNA, 1811 bp, Homo sapiens
gagcggggaggagggagtgaagggcacagctgaggcagacacccctttccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccaagaggcggtccccagagaagcggagggagggcacccgcagcgccgacaacactttggagaggagggagaagcacgagaagagacgagacgtctctccggagcggaggcgagagcggtcacccacccgcaggagagacggctcccccagccggcggagacggtctctggagagactcctggagcagaggaggtcccccgagcgcaggagagggggctcgcccgagcgcagggccaagtccaccgaccggaggcgcgcacgctcccccgagcgcaggagagagcggtccctggacaaaaggaacagagaggacagagccagccaccgagaaagggaagaggcgaatctgaaacaggatgccggcagaagttccagacatcccccggagcagagaaggcgaccttacaaagaatgtagcaccgacctcagtatctgagacgctgagtcacattccaacctttaccgtgtcaaaggttctaagaggaaagtcacaaacctgaaattatttagtttcttacctaatgaagcatctgacacctgatgatcctatgaataacaacaaacattttatgcatttgaaatcttataagaaaaaatatatatgaaaagtattgtgcctgatgtatcatattaaagaaagtatttttaaatgc

SEQ ID NO: 298722 - DNA, 452 bp, Homo sapiens
gtagatggtgactgacggcagcgtttattaattggcattaacccctagcgggaagcctctgtcctcccgacatagtctggtttgggcaggcctccttggagctgctaggtgtcccaggggcagccagggtgcagcttgtgggtggggaggtgcgcctcacgcacatgcgtattcactgcacactctgctcctcttagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggtgagggtcggctgaagggtgcagtgtgggtgggtgg

SEQ ID NO: 298723 - DNA, 858 bp, Homo sapiens
  misc_feature (226)..(226): n is a, c, g, or t
cccacaccccacacccccaccccacaaatatgtataggtgcggaccgggatcttatgtctagcttcgtgtgacggcgtatagtgcaaaacggtgggacccaccagctctctccccatcccgcttcttccctgggggccaggccctacctgtgtggtggtgggtgggctgtcaagacgtgtcatgtacatttgtatcaaaaataaagaagtgaccatgaaaaaaaanaaaaaaaaaaaaaaaaaaaaaaaaaaaaaaaaaaaaaaaaaaaaaacaacgggcgggcagcaaattctatctaggggggggcgaaaagagagaagaaaaaaaaaagaagcacacgtcgaacacaaaagagggacgcgaagaacccacactattatataaaacaagagaacgagggacaccaactagagcgaggggcgacccacaccaaaaaagaggacgacaaactaaaaccaaatcaagaaacacccgagaggaacacacacgcgactaaacaaacaagaagacacagaagaaaaagaagacaacaacgaaaaagcaacaaaacaagaacaagaccccagcaaaccccaccacgagccgaaccacgaacaacgaccagtacgacgtatcctggccaggataacacgaaaaacaatcagacaaagaaaaaacagccaaacgctatgagcacgaagaacaccgtaaatcaggataacagatggcgtaaaaaagcacagcattgggcgcagatgaatggatatcagtagcagtaggaagcgagacaacaggcgcggcgacgcgaggaaaacggatggaggaacaattagcaaagcgactcaggtaaaggcggaacgaggacaacaacgaagata

SEQ ID NO: 298724 - DNA, 391 bp, Homo sapiens
gtagatggtgactgacggcagcgtttattaattggcattaacccctagcgggaagcctctgtcctcccgacatagtctggtttgggcagaggcatggagggtagaaatgctgcatgggaatggaggcagcccccgggctggagcacagcatgggaggcagggaaccctacaagcaagactgggatagagacgagctggagaatgagcagccccgagagcatcagcaggagcagtgaccatcccgagagcggagagttccaggcacagaagtgtgaagtcatctctgctgcttactggctgtgtgacttgcaggctgcttgacctctctgagccttggttatctctcctggaaatggagatgacagcatctatttttcagggaggagaggat

SEQ ID NO: 298725 - DNA, 3305 bp, Homo sapiens
gtagatggtgactgacggcagcgtttattaattggcattaacccctagcgggaagcctctgtcctcccgacatagtctggtttgggcaggcctccttggagctgctaggtgtcccaggggcagccagggtgcagcttgtgggtggggaggtgcgcctcacgcacatgcgtattcactgcacactctgctcctcttagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatga

SEQ ID NO: 298726 - DNA, 3569 bp, Homo sapiens
agagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagatctcggcaaaagtgcatgtctcagagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatga

SEQ ID NO: 298727 - DNA, 3494 bp, Homo sapiens
agagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcaacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatga

SEQ ID NO: 298728 - DNA, 3146 bp, Homo sapiens
  misc_feature (393)..(393): n is a, c, g, or t
ttgtataattgtacaacctttgaaagttacataagttgtaatgatctaatactattaatagccattcagaaaacactttccctccctcccaacatccatccagggggaaataaatgtcctgaaaagaggccagttcaacatggcctctaccctggtagaaacaaaaagtgaaaagagaagaaaacagaaatcaactaagaggtgttgccagtgtctctcaggagtggggccctggctgttgcctggggtcatgaaaggcagagcctgcagcatgcagtatggcagccgggagaccttgcagccacatcttcctcaccccggcacatccacatcccaacttaggtgtcatggaaatctttcagcagggttctcctccgctgctccgctatcctngtggcgaattcggcacgagggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatga

SEQ ID NO: 298729 - DNA, 2834 bp, Homo sapiens
  misc_feature (393)..(393): n is a, c, g, or t
ttgtataattgtacaacctttgaaagttacataagttgtaatgatctaatactattaatagccattcagaaaacactttccctccctcccaacatccatccagggggaaataaatgtcctgaaaagaggccagttcaacatggcctctaccctggtagaaacaaaaagtgaaaagagaagaaaacagaaatcaactaagaggtgttgccagtgtctctcaggagtggggccctggctgttgcctggggtcatgaaaggcagagcctgcagcatgcagtatggcagccgggagaccttgcagccacatcttcctcaccccggcacatccacatcccaacttaggtgtcatggaaatctttcagcagggttctcctccgctgctccgctatcctngtggcgaattcggcacgagggacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatga

SEQ ID NO: 298730 - DNA, 3624 bp, Homo sapiens
agagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatga

SEQ ID NO: 298731 - DNA, 3788 bp, Homo sapiens
agagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaaggtacaggggccaaagagaggaccaggagtgggagggcctcgagctggggcaggcgtggagaatcccatctgatcgctacctgggtggagacacagacaaactgggccctgatctcagctggcggcttaaagtccaaggtccagcctcactcctgccccctccagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatga

SEQ ID NO: 298732 - DNA, 1848 bp, Homo sapiens
gagcggggaggagggagtgaagggcacagctgaggcagacacccctttccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatga

SEQ ID NO: 298733 - DNA, 1646 bp, Homo sapiens
  misc_feature (18)..(19): n is a, c, g, or t
  misc_feature (28)..(28): n is a, c, g, or t
cctagatcctgggcttcnntgctctgtnttcaagatgacatcctctgtgctgggaagcccaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatga

SEQ ID NO: 298734 - DNA, 3881 bp, Homo sapiens
  misc_feature (3550)..(3550): n is a, c, g, or t
agagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatgaaaaaaaanaaaaaaaaaaaaaaaaaaaaaaaaaaaaaatttgtgggcggccgggcccgaaaaatttttaaacccttcccgttgtggggccgcgcgcgcgggcccccacgttagtgttaggtgtgaacacgtgcgctccaaaacggtgtcttaccaagagaaaaccggggccaaggaacacggtgcttgtgggtttctcccacaaataaaaaaacggcccgggggggaacccgaagccgtttctggaaacacattccagagggagtccggaaggcacatacgggcgctctactacaccggaggtcccaggcgagcccaatctcatataaccgagcgggga

SEQ ID NO: 298735 - DNA, 3444 bp, Homo sapiens
  misc_feature (3392)..(3392): n is a, c, g, or t
  misc_feature (3395)..(3395): n is a, c, g, or t
  misc_feature (3402)..(3402): n is a, c, g, or t
  misc_feature (3405)..(3405): n is a, c, g, or t
  misc_feature (3411)..(3411): n is a, c, g, or t
  misc_feature (3416)..(3416): n is a, c, g, or t
  misc_feature (3425)..(3425): n is a, c, g, or t
agagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcaaggccagcacccaccatcactacctgcacctgctgtggtcccaccctctggaggcctgggaacctggctggaagntgnagcacgnggncccatnttccnccgtttccngggccggcacctgtggggg

SEQ ID NO: 298736 - DNA, 3470 bp, Homo sapiens
agagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagccagggactgtccgggtagccagttttggtcctgccagctgcctccctgatccctccccactctcgccccttctctatgaacttaaatcaaaaaccacttccctccatctcctcctgctcctgcgtggagggggaatgtgtgctggctagggtggaggactgagcacctgagcctggggctggctccccggggtccccgactcagctggtggctgtggagctgagtcccctccccgtaacctctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatga

SEQ ID NO: 298737 - DNA, 3361 bp, Homo sapiens
agagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagcgctccccggggtccccgactcagctggtggctgtggagctgagtcccctccccgtaacctctgcaaggccagcacccaccatcactacctgcacctgctgtggtcccaccctctggaggcctgggaacctggctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatga

SEQ ID NO: 298738 - DNA, 3297 bp, Homo sapiens
agagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttcttccccaccccttaattttaactttgtggtaactgagtgcccccgcgtgcctgcgtgttgagtgtgtgggcggcagtgccgttccggaggcctggtccatctggagttttgaggggtgaggggaccagagcagtgggaccagcatggggatcagcttcccttccccacctggagcctggtggctgtggagctgagtcccctccccgtaacctctgcaaggccagcacccaccatcactacctgctgcagcctgggaaggctggagaggcagacggtgggacccaccagctctctccccatcccgcttcttccctgggggccaggccctacctgtgtggtggtgggtgggctgtcaagacgtgtcatgtacatttgtatcaaaaataaagaagtgaccatga

SEQ ID NO: 298739 - DNA, 3059 bp, Homo sapiens
agagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcactggccataggagctgggccactccagacattaatccccaccccaacagagccactggcacaagtgcccttagtgctgccacactccctggcagccaggtgccctggtgcccacccctgtcgagcccctaaggatggggaggtgggggggcaggagcttctgtcccccacattccatgcacctcccctctgtatatagcatctcccccctcctagtgagcaggggcctgcaaggcatcactcccagcccctcgccttctagggcaccctcagcaaaggggcaggtggggacactccaagtggggcagctctccgtacatgcgccccacccccatgagccagttcagccctactgggggctgagcgggggcatcccctcctttgtacatagtctccatggatgtccctgccctgtagccaccagccccttgctgctctccctttaatgccatatggcccctgcctagggcacaggccccaacctgtgtgctggggtccccagcagcaaacactggaaagtctgttttttttttttctttcttctgctccccggggtccccgactcagctggtggctgtggagctgagtcccctccccgtaacctctgcaaggccagcacccaccatcactacctgctgtgtggtggtgggtgggctgtcaagacgtgtcatgtacatttgtatcaaaaataaagaagtgaccatga

SEQ ID NO: 298740 - DNA, 2375 bp, Homo sapiens
agagggctgcggccgcgtcgccgctgaggatgtcccgaaaggggccgcgagcggaggtgtgtgcggactgcagcgccccggaccctggctgggcatccatcagcaggggtgtgctggtgtgtgacgagtgctgcagcgtgcaccggagcctgggacgccacatctccattgtcaagcaccttcgccacagcgcctggcctcccacgctgctgcagatggtgcacacgcttgccagcaacggggccaactccatctgggagcactccctgctggaccccgcacaagtgcagagcggccggcgtaaagccaacccccaagacaaagtccaccccatcaagtcagagttcatcagggccaagtaccagatgctggcatttgtgcacaagcttccctgccgggacgatgatggagtcaccgccaaagacctcagcaagcaactacactcgagcgtgcggacaggcaacctggagacatgtctgcgcctgctctccctgggtgcccaggccaacttcttccacccagagaagggcaccacacctctgcacgtggctgccaaggcaggacagacactgcaggccgagctgcttgtagtgtatggggctgaccctggctcccctgatgttaatggccgcacacccattgactatgccaggcaggcggggcaccatgagctggcggaaaggctggttgagtgccaatatgagctcactgaccggctggccttctacctctgtggacgcaagccggatcacaagaatgggcattacatcatcccacagatggctgacagccttgacttatccgaattggccaaagctgctaagaagaagctgcaggcgctcagcaaccggctttttgaggaactcgccatggacgtgtatgacgaggtggatcgaagagaaaatgatgcagtgtggctggctacccaaaaccacagcactctggtgacagagcgcagtgccgtgcccttcctgcctgttaacccggaatactcagccacgcggaatcaggggcgacaaaagctggcccgctttaatgcccgagagtttgccaccttgatcatcgacattctcagtgaggccaagcggagacagcagggcaagagcctgagcagccccacagacaacctcgagctgtctctgcggagccagagtgacctcgacgaccaacacgactacgacagcgtggcctctgacgaggacacagaccaggagcccctgcgcagcaccggcgccactcggagcaaccgggcccggagcatggactcctcggacttgtctgacggggctgtgacgctgcaggagtacctggagctgaagaaggccctggctacatcggaggcaaaggtgcagcagctcatgaaggtcaacagtagcctgagcgacgagctccggaggctgcagcgagagatccacaagctgcaggcggagaacctgcagctccggcagcctccagggccggtgcccacacctccactccccagtgaacgggcggaacacacacccatggcgccaggcgggagcacacaccgcagggatcgccaggccttttccatgtatgaacctggctctgccctgaagccctttgggggcccccctggggacgagctcactacgcggctgcagcctttccacagcactgagctagaggacgacgccatctattcagtgcacgtccctgctggcctttaccggatccggaaaggggtgtctgcctcagctgtgcccttcactccctcctccccgctgctgtcctgctcccaggagggaagccgccacacgagcaagctttcccgccacggcagtggagccgacagtgactatgagaacacgcaaagtggggacccactgctggggctggaagggaagaggtttctagagctgggcaaagaggaagacttccacccagagctggaaagcctggatggagacctagatcctgggcttcccagcacagaggatgtcatcttgaagacagagcaggtcaccaagaacattcaggaactgttgcgggcagcccaggagttcaagcatgacagcttcgtgccctgctcagagaagatccatttggctgtgaccgagatggcctccctcttcccaaagaggccagccctggagccagtgcggagctcactgcggctgctcaacgccagcgcctaccggctgcagagtgagtgccggaagacagtgcccccagagcccggcgccccagtggacttccagctgctgactcagcaggtgatccagtgcgcctatgacatcgccaaggctgccaagcagctggtcaccatcaccacccgagagaagaagcagtgacctctctccccacaccctcacctgcaccctaggacctcacacaccgtcaaaaaaaaaaaa

SEQ ID NO: 298741 - DNA, 543 bp, Homo sapiens
aaaatcaccctggctgctgggtggaacaggattgtagggacaaaactagaaggagggagattaagaaacttacaaagcccaggcaacaggtgattgaggaacctggggagcttcactaggactggagggtgagggaggcttcaggtgactgccaggtggctgacactggtggtggacaaacaggtcactgagaggaagagcaagccagaggaggaggggtgggggacgcggtgagatgaattcagctttgtcccttctgggccgggtgtgcgtggagatgggtctgggcctgatgtgaaaaggcgtgtgctgccctgctcctgggtaactgccgcctctgtcctgttcttccctctgctgccttcctctggacttagatctcggcaaaagtgcatgtctcagaggtatatggtgcctgccggggcagcaggcctgaaggtggggtagggcggggaggcatttggtgtgcagcatctggggtgccatctccccgggatccctgcatgttggggaggttgctggcatgggcctggccacctctca

SEQ ID NO: 298742 - DNA, 855 bp, Homo sapiens
cggaagtgtgggcgcggctgcggtttaacccgcggtggcggcggcgacggcggccctggcagggaaggatggagacgctgaaggataagaccctgcaggagctggaggagttgcagaatgactcggaggcgattgaccagctggccctggagtcccctgaggtccaggacctacagctggaacgggagatggcactggccaccaaccggagcctggcagagcggaacttggagttccagggtcccctggagatcagccgctcaaacctctcggatagataccaggagctccggaagctcgtggagcggtgccaggagcagaaggcaaagctggagaaattttcttcagcactgcagccagggaccttgttagaccttctgcaggtggaaggcatgaagatcgaagaagagtccgaggtgagagggcgaggcgacacccctcttccctggacggggtgtcagtccctgcagcaggggcccttggaaggagaagcagatgtctgcaaagcatggaacaagggagctttcgtagatggcagaggtgaaggacatctttagtcctggggaggccttttgggtataaataacaggaacccagtcccactagctgaagcagaaacgggtgacagtggacaagggcagctcgcagccctggatggtagggcagcacagcaggaggcccccaggggctgaggccagctccctactccactctccctgcttcctgcttccctccggccacctcttcagcctctgtgggcaaactggtgctgtccactctgtgtctgggtggaagaagcttctaggccctcccagtccctgggctagtgctcatccaggtgttcagcacatatat

SEQ ID NO: 298743 - DNA, 2699 bp, Homo sapiens
cggaagtgtgggcgcggctgcggtttaacccgcggtggcggcggcgacggcggccctggcagggaaggatggagacgctgaaggataagaccctgcaggagctggaggagttgcagaatgactcggaggcgattgaccagctggccctggagtcccctgaggtccaggacctacagctggaacgggagatggcactggccaccaaccggagcctggcagagcggaacttggagttccagggtcccctggagatcagccgctcaaacctctcggatagataccaggagctccggaagctcgtggagcggtgccaggagcagaaggcaaagctggagaaattttcttcagcactgcagccagggaccttgttagaccttctgcaggtggaaggcatgaagatcgaagaagagtccgaggccatggctgagaagttcctggagggcgaggtgcccctggaaacgttcctggagaatttttcctccatgaggatgctgtcccacctgcgccgggttcgcgtggaaaagctccaggaagtggtgaggaagcccagggcttcccaggagctggccggcgatgcccctccagcccgtccaccagccccggtgcgcccagtcccccagggaacaccccctgtggttgaagagcagccgcagccaccatcagccatgcctccctaccctttgccctacagcccatcccccagcctgcctgtgggccccactgcccatggagccctgccaccggcccctttcccagtagtgtcccagccctccttctacagcgggcctctgggccccacttacccggcagcccagcttggacccaggggtgctgcgggttactcctggtccccacagaggagcatgccaccccggccgggctatcctgggaccccaatgggtgcctctgggcctgggtaccccttgcggggaggcagggcccccagtcctggttatcctcaacagtccccataccccgcaacaggaggaaaacctccctacccaatacagcctcagctccccagctttccaggccagccccagccctcagtgcccctgcagcccccttatccccccgggcccgcccctccctatgggttcccaccaccgccggggcctgcctggcctgggtattagacacactcctggccctcggcccctccctagtcccacccacgctcaacctttggcccagccatcgccgagattcgagggtcaactggaagtggcgttggtgctccctgtggacttgcgtcggcacccagaggccttggagggacaaggcactgggcggtgtgactggtcatggcacttgctggccttctggccagaggtcctcctggaagcccctcctttcagtgcctggctgcagcggtgctagccaggctggagtccagcacctctcgccggtgtctgtgtgagtgagcgcatgtgcgcatttatgagcatctacttgcggctgcactcagggccatttgaacccagtgcagagttatctctatgaggaggccccgggtctccagccccctccatctcccctggggtttggcatatttgacatggagccccatgccaagggatgcagctgttggtgtctgtccagtccattcaaggctagcctgcccatgcactgtggcaggggttggattggagggagagaacagagttgggaaaaacaacaggtttgagtcctataaagccataatttaactccagtagctgatgtcagacaagcttgtcctatgtcctatttgagtggcagcagcgccagcccagcaagaaggctgggggttgtcaaggttgtccccagaccttgcttgcagtggttggagaacccagggggctgccttgggccctctggccagagggaagcgggcagctctagccctggagattgtggtcacattggggcttgtttaggattggagggccaggtcacctccccagccaccctcccttctctcctctggggtccccactttagggcgactttgcccgaggcccacgcatccatccactcctttagtgccttgaatctcattcacaagcagccccctcccttcccctccccttctcactctgttgatgtaatcctcccacccccagtgtccatcctaagacaggcatcaaaagaggccctaactttacttcccaaatggtgctttttaaaaaacaccatcactacattaggggcaattttttcacacctccctgtcttcagaatgtaaagggtggggattatgtctctgtttaatatgcagccccctgcactgtggggtttggggcatgttcagtaataagaatgaatacaatagacaaagggggtgtgatgagtgttaacttggttgttccagaggtaaaccaggtctcagggaagagcctggagctgctattgcttaggaagttgtacgtgccttgaaatgtccactacctgaggacgcagcatctggtgggcccggggctgctggggccaaggagggaccttgaccttctggtgcctgcccctccccggcctacgtgccatccgcgtgacgctaggtcagcgctgccggttctttaccaaatgtgcttgcttctcctaagttatttataaagagaaatcactaatggactctactggtttgagtgcttctgagctggatgaccgaccgcctgtatgtttgtgtaattaattgccataataaactttgatgagtcaca

SEQ ID NO: 298744 - DNA, 3009 bp, Homo sapiens
  misc_feature (2767)..(2767): n is a, c, g, or t
cggaagtgtgggcgcggctgcggtttaacccgcggtggcggcggcgacggcggccctggcagggaaggatggagacgctgaaggataagaccctgcaggagctggaggagttgcagaatgactcggaggcgattgaccagctggccctggagtcccctgaggtccaggacctacagctggaacgggagatggcactggccaccaaccggagcctggcagagcggaacttggagttccagggtcccctggagatcagccgctcaaacctctcggatagataccaggagctccggaagctcgtggagcggtgccaggagcagaaggcaaagctggagaaattttcttcagcactgcagccagggaccttgttagaccttctgcaggtggaaggcatgaagatcgaagaagagtccgaggccatggctgagaagttcctggagggcgaggtgcccctggaaacgttcctggagaatttttcctccatgaggatgctgtcccacctgcgccgggttcgcgtggaaaagctccaggaagtggtgaggaagcccagggcttcccaggagctggccggcgatgcccctccagcccgtccaccagccccggtgcgcccagtcccccagggaacaccccctgtggttgaagagcagccgcagccaccatcagccatgcctccctaccctttgccctacagcccatcccccagcctgcctgtgggccccactgcccatggagccctgccaccggcccctttcccagtagtgtcccagccctccttctacagcgggcctctgggccccacttacccggcagcccagcttggacccaggggtgctgcgggttactcctggtccccacagaggagcatgccaccccggccgggctatcctgggaccccaatgggtgcctctgggcctgggtaccccttgcggggaggcagggcccccagtcctggttatcctcaacagtccccataccccgcaacaggaggaaaacctccctacccaatacagcctcagctccccagctttccaggccagccccagccctcagtgcccctgcagcccccttatccccccgggcccgcccctccctatgggttcccaccaccgccggggcctgcctggcctgggtattagacacactcctggccctcggcccctccctagtcccacccacgctcaacctttggcccagccatcgccgagattcgagggtcaactggaagtggcgttggtgctccctgtggacttgcgtcggcacccagaggccttggagggacaaggcactgggcggtgtgactggtcatggcacttgctggccttctggccagaggtcctcctggaagcccctcctttcagtgcctggctgcagcggtgctagccaggctggagtccagcacctctcgccggtgtctgtgtgagtgagcgcatgtgcgcatttatgagcatctacttgcggctgcactcagggccatttgaacccagtgcagagttatctctatgaggaggccccgggtctccagccccctccatctcccctggggtttggcatatttgacatggagccccatgccaagggatgcagctgttggtgtctgtccagtccattcaaggctagcctgcccatgcactgtggcaggggttggattggagggagagaacagagttgggaaaaacaacaggtttgagtcctataaagccataatttaactccagtagctgatgtcagacaagcttgtcctatgtcctatttgagtggcagcagcgccagcccagcaagaaggctgggggttgtcaaggttgtccccagaccttgcttgcagtggttggagaacccagggggctgccttgggccctctggccagagggaagcgggcagctctagccctggagattgtggtcacattggggcttgtttaggattggagggccaggtcacctccccagccaccctcccttctctcctctggggtccccactttagggcgactttgcccgaggcccacgcatccatccactcctttagtgccttgaatctcattcacaagcagccccctcccttcccctccccttctcactctgttgatgtaatcctcccacccccagtgtccatcctaagacaggcatcaaaagaggccctaactttacttcccaaatggtgctttttaaaaaacaccatcactacattaggggcaattttttcacacctccctgtcttcagaatgtaaagggtggggattatgtctctgtttaatatgcagccccctgcactgtggggtttggggcatgttcagtaataagaatgaatacaatagacaaagggggtgtgatgagtgttaacttggttgttccagaggtaaaccaggtctcagggaagagcctggagctgctattgcttaggaagttgtacgtgccttgaaatgtccactacctgaggacgcagcatctggtgggcccggggctgctggggccaaggagggaccttgaccttctggtgcctgcccctccccggcctacgtgccatccgcgtgacgctaggtcagcgctgccggttctttaccaaatgtgcttgcttctcctaagttatttataaagagaaatcactaatggactctactggtttgagtgcttctgagctggatgaccgaccgcctgtatgtttgtgtaattaattgccataataaactttgatgagtcacaaaaaaaaaaaaacaaacaaaacacaaaaaacaacaaaagaagggagagacgacaatcaaatgatgatnagattgccaatgaagagaaagaacaacgaagttagacgagcagaacacaacaactagcggtgagagacaacaagggagccccgatacagatggagcgacagcgatgacgcagaggaggatcctgagactgccggggacgagcgcggggtgcgggagcaacagggtattacagtagcgacaggtagggaatgaagagcaatgacagcgcaggggggggcagcgacgtggcagaccaacacgga

SEQ ID NO: 298745 - DNA, 287 bp, Homo sapiens
cggccgcgagcgtgtgtgtgtggcacgatgtcgtggtaactcagaggcgcgcgaggcggggcggccaacggggtcgcggggcgagcacgcgcgccactggggcgccggacgttgcaagggggtcacatccggtagggggcgggcctggcggaccccggaagtgtgggcgcggctgcggtttaacccgcggtggcggcggcgacggcggccctggcaggtgagcggagactggggagggtcccggctctgccgcaggcgggcggggcagaggacgacggtgggggcgg

SEQ ID NO: 298746 - DNA, 1934 bp, Homo sapiens
ccgggtccagcctgttgctgatgctgccgtgcggtacttgtcatggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagggcggtccaggcggttctagcactggatttggaaactttgaggaaattgggccccttgacagtgatctcaaaccacggaaaaccacctggctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatggaggaaaaatggcagctggcattggtctagagctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtctacaatggagtcgagtctagaattcacacagagccacctagtttgtctttgtcagcgccacgtgagacacctacaacgagatgccttaagccagctcatgaatggccccatcagaaagaagctcaaaattattcctgaggatcaatcctggggaggccaggctaccaacgtctttgtgaacatggaggaggacttcatgaagccagtcattagcattgtggacgagttgctggaggcagggatcaacgtgacggtgtataatggacagctggatctcatcgtagataccatgggtcaggaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtgactcagcaagaataggatggatggggctggagatgagctggtttggccttggggcacagagctgagctgaggccgctgaagctgtaggaagcgccattcttccctgtatctaactggggctgtgatcaagaaggttctgaccagcttctgcagaggataaaatcattgtctctggaggcaatttggaaattatttctgcttcttaaaaaaacctaagattttttaaaaaattgatttgttttgatcaaaataaaggatgataatagatattattttttcttatgacagaagcaaatgatgtgatttatagaaaaactgggaaatacaggtacccaaagagtaaatcaacatctgtatacccccttcccaggggtaagcactgttaccaatttagcatatgtccttgcagaatttttttttctatatatacatatatattttttaccaaaatgaatcattactctatgttgttttactatttgtttgacatatcagtatatctgaaacaccttttcatgtcaataaatgttcttctctaacatttttaa

SEQ ID NO: 298747 - DNA, 2273 bp, Homo sapiens
  misc_feature (2032)..(2032): n is a, c, g, or t
  misc_feature (2115)..(2116): n is a, c, g, or t
ccgggtccagcctgttgctgatgctgccgtgcggtacttgtcatggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagggcggtccaggcggttctagcactggatttggaaactttgaggaaattgggccccttgacagtgatctcaaaccacggaaaaccacctggctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatggaggaaaaatggcagctggcattggtctagagctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtctacaatggagtcgagtctagaattcacacagagccacctagtttgtctttgtcagcgccacgtgagacacctacaacgagatgccttaagccagctcatgaatggccccatcagaaagaagctcaaaattattcctgaggatcaatcctggggaggccaggctaccaacgtctttgtgaacatggaggaggacttcatgaagccagtcattagcattgtggacgagttgctggaggcagggatcaacgtgacggtgtataatggacagctggatctcatcgtagataccatgggtcaggaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtgactcagcaagaataggatggatggggctggagatgagctggtttggccttggggcacagagctgagctgaggccgctgaagctgtaggaagcgccattcttccctgtatctaactggggctgtgatcaagaaggttctgaccagcttctgcagaggataaaatcattgtctctggaggcaatttggaaattatttctgcttcttaaaaaaacctaagattttttaaaaaattgatttgttttgatcaaaataaaggatgataatagatattattttttcttatgacagaagcaaatgatgtgatttatagaaaaactgggaaatacaggtacccaaagagtaaatcaacatctgtatacccccttcccaggggtaagcactgttaccaatttagcatatgtccttgcagaatttttttttctatatatacatatatattttttaccaaaatgaatcattactctatgttgttttactatttgtttgacatatcagtatatctgaaacaccttttcatgtcaataaatgttcttctctaacatttttaaacaacaacaaaaaaaaaactccgggggcctctatgccggcggcgggaaaaagggcgcggaaggggccctggatcccttagctgtttccctgaacccgnttctctcgttccacaagtgtggagaaccggcgcgccccctaagggggtcgtttttaatttcgcataagccgggtcatcacaanngcgcgaacaagaaaaaacgggcaacgagcgagagcgacaaaactccaacaaagagcaaaaaacgaaaaacccacaacaacaaacacatataaaaaaaacaaacaaaaataagccatcaaagaaaacacaacaaaaaaaaagaagaatacgaacagca

SEQ ID NO: 298748 - DNA, 882 bp, Homo sapiens
cggcacgaggcccgctgggggtgaatcaaggtgacgcttttccttttccagctgaatctgaaaccctccctcttgctgtgcagcatccccagcagcttggtaaagatgtcctcatggccaggcgtggtggctcacacctgtaatcccacctcagcctcccgaagtgctgggattacagacatgagccaccaggcccagccaaagctctatttctttctgatccaagcagatatacaaaattaaacctgtccttggataagataaagagccatgtgtccttctgtttggcagctttgatgataggaaaatgaaacaaacagccaaataaacttttatatttcagaacacagatggggtgaacttctataacatcttaactaaaagcactcccacgtctacaatggagtcgagtctagaattcacacagagccacctaggtgagtgaaccttgaagttattaaagtccctgcctcagcctccatgcaaaaagaaacctgtttattaaaaaaaaaaaaaactttattaacatataatttgcataccataaaattaactcactgtaagtggttttcagtatattcccagagttgtgcagtcatcactacaatccagttatggagcatttctgtcaccccaaggagatcccacgtgtctgcttgcagacagttctcattcccactcccagccacaggcaaccactcatctgccttctgtctctctagattttccttttctgaacattttatataaatacaatcgcacaatagttagtcttttgcactggcttctgtcacatagcatgatgtttttgaagtttagaaaccagcttccatacaccaaattacaacatcagttcaagactgaatttagtcatctttcagc

SEQ ID NO: 298749 - DNA, 1880 bp, Homo sapiens
ccgggtccagcctgttgctgatgctgccgtgcggtacttgtcatggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagggcggtccaggcggttctagcactggatttggaaactttgaggaaattgggccccttgacagtgatctcaaaccacggaaaaccacctggctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatggaggaaaaatggcagctggcattggtctagagctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtctacaatggagtcgagtctagaattcacacagagccacctagtttgtctttgtcagcgccacgtgagacacctacaacgagatgccttaagccagctcatgaatggccccatcagaaagaagctcaaaatggaggaggacttcatgaagccagtcattagcattgtggacgagttgctggaggcagggatcaacgtgacggtgtataatggacagctggatctcatcgtagataccatgggtcaggaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtgactcagcaagaataggatggatggggctggagatgagctggtttggccttggggcacagagctgagctgaggccgctgaagctgtaggaagcgccattcttccctgtatctaactggggctgtgatcaagaaggttctgaccagcttctgcagaggataaaatcattgtctctggaggcaatttggaaattatttctgcttcttaaaaaaacctaagattttttaaaaaattgatttgttttgatcaaaataaaggatgataatagatattattttttcttatgacagaagcaaatgatgtgatttatagaaaaactgggaaatacaggtacccaaagagtaaatcaacatctgtatacccccttcccaggggtaagcactgttaccaatttagcatatgtccttgcagaatttttttttctatatatacatatatattttttaccaaaatgaatcattactctatgttgttttactatttgtttgacatatcagtatatctgaaacaccttttcatgtcaataaatgttcttctctaacatttttaa

SEQ ID NO: 298750 - DNA, 1820 bp, Homo sapiens
ccgggtccagcctgttgctgatgctgccgtgcggtacttgtcatggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagggcggtccaggcggttctagcactggatttggaaactttgaggaaattgggccccttgacagtgatctcaaaccacggaaaaccacctggctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatggaggaaaaatggcagctggcattggtctagagctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtctacaatggagtcgagtctagaattcacacagagccacctaggccaggctaccaacgtctttgtgaacatggaggaggacttcatgaagccagtcattagcattgtggacgagttgctggaggcagggatcaacgtgacggtgtataatggacagctggatctcatcgtagataccatgggtcaggaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtgactcagcaagaataggatggatggggctggagatgagctggtttggccttggggcacagagctgagctgaggccgctgaagctgtaggaagcgccattcttccctgtatctaactggggctgtgatcaagaaggttctgaccagcttctgcagaggataaaatcattgtctctggaggcaatttggaaattatttctgcttcttaaaaaaacctaagattttttaaaaaattgatttgttttgatcaaaataaaggatgataatagatattattttttcttatgacagaagcaaatgatgtgatttatagaaaaactgggaaatacaggtacccaaagagtaaatcaacatctgtatacccccttcccaggggtaagcactgttaccaatttagcatatgtccttgcagaatttttttttctatatatacatatatattttttaccaaaatgaatcattactctatgttgttttactatttgtttgacatatcagtatatctgaaacaccttttcatgtcaataaatgttcttctctaacatttttaa

SEQ ID NO: 298751 - DNA, 1784 bp, Homo sapiens
cgggggcggttggcctttctttgtttttgtttttttttctatgttcctgtcccttatttttaaaaatctcttttagcaacagggatatcatcaccacgctggtatcctcacatgtgtgggttttgctgagctagtagaaaatgatccaaagatgattggtgaccaaatgtctgattgcaacatttcgttttcctccgtggtacatagctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatggaggaaaaatggcagctggcattggtctagagctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtctacaatggagtcgagtctagaattcacacagagccacctagtttgtctttgtcagcgccacgtgagacacctacaacgagatgccttaagccagctcatgaatggccccatcagaaagaagctcaaaattattcctgaggatcaatcctggggaggccaggctaccaacgtctttgtgaacatggaggaggacttcatgaagccagtcattagcattgtggacgagttgctggaggcagggatcaacgtgacggtgtataatggacagctggatctcatcgtagataccatgggtcaggaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtgactcagcaagaataggatggatggggctggagatgagctggtttggccttggggcacagagctgagctgaggccgctgaagctgtaggaagcgccattcttccctgtatctaactggggctgtgatcaagaaggttctgaccagcttctgcagaggataaaatcattgtctctggaggcaatttggaaattatttctgcttcttaaaaaaacctaagattttttaaaaaattgatttgttttgatcaaaataaaggatgataatagatattattttttcttatgacagaagcaaatgatgtgatttatagaaaaactgggaaatacaggtacccaaagagtaaatcaacatctgtatacccccttcccaggggtaagcactgttaccaatttagcatatgtccttgcagaatttttttttctatatatacatatatattttttaccaaaatgaatcattactctatgttgttttactatttgtttgacatatcagtatatctgaaacaccttttcatgtcaataaatgttcttctctaacatttttaa

SEQ ID NO: 298752 - DNA, 1259 bp, Homo sapiens
ccgggtccagcctgttgctgatgctgccgtgcggtacttgtcatggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagggcggtccaggcggttctagcactggatttggaaactttgaggaaattgggccccttgacagtgatctcaaaccacggaaaaccacctggctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatggaggaaaaatggcagctggcattggtctagagctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtctacaatggagtcgagtctagaattcacacagagccacctagtttgtctttgtcagcgccacgtgagacacctacaacgagatgccttaagccagctcatgaatggccccatcagaaagaagctcaaaattattcctgaggatcaatcctggggaggccaggctaccaacgtctttgtgaacatggaggaggacttcatgaagccagtcattagcattgtggacgaggctggatggggtgactgacagtccagatcattgaaacagattgggtcgtcggaaactggtccacatgaggctggatggggtgactgacagtctggatcattgaaactgattaggtcgtcaaaacgggtcaagacgagatgaggctaggctga

SEQ ID NO: 298753 - DNA, 1994 bp, Homo sapiens
ccgggtccagcctgttgctgatgctgccgtgcggtacttgtcatggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagggcggtccaggcggttctagcactggatttggaaactttgaggaaattgggccccttgacagtgatctcaaaccacggaaaaccacctggctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatggaggaaaaatggcagctggcattggtctagagctttataaggccattcagcgagggaccatcaagtgcaactttgcgggggttgccttgggtgattcctggatctcccctgttgattcggtgctctcctggggaccttacctgtacagcatgcaataccagattgacgttcccaagtaaagtgggtctttttgctcttggtttgcattccagtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtctacaatggagtcgagtctagaattcacacagagccacctagtttgtctttgtcagcgccacgtgagacacctacaacgagatgccttaagccagctcatgaatggccccatcagaaagaagctcaaaattattcctgaggatcaatcctggggaggccaggctaccaacgtctttgtgaacatggaggaggacttcatgaagccagtcattagcattgtggacgagttgctggaggcagggatcaacgtgacggtgtataatggacagctggatctcatcgtagataccatgggtcaggaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtgactcagcaagaataggatggatggggctggagatgagctggtttggccttggggcacagagctgagctgaggccgctgaagctgtaggaagcgccattcttccctgtatctaactggggctgtgatcaagaaggttctgaccagcttctgcagaggataaaatcattgtctctggaggcaatttggaaattatttctgcttcttaaaaaaacctaagattttttaaaaaattgatttgttttgatcaaaataaaggatgataatagatattattttttcttatgacagaagcaaatgatgtgatttatagaaaaactgggaaatacaggtacccaaagagtaaatcaacatctgtatacccccttcccaggggtaagcactgttaccaatttagcatatgtccttgcagaatttttttttctatatatacatatatattttttaccaaaatgaatcattactctatgttgttttactatttgtttgacatatcagtatatctgaaacaccttttcatgtcaataaatgttcttctctaacatttttaa

SEQ ID NO: 298754 - DNA, 1367 bp, Homo sapiens
ccgggtccagcctgttgctgatgctgccgtgcggtacttgtcatggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagggcggtccaggcggttctagcactggatttggaaactttgaggaaattgggccccttgacagtgatctcaaaccacggaaaaccacctggctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatggaggaaaaatggcagctggcattggtctagagctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtctacaatggagtcgagtctagaattcacacagagccacctaggtgagtgaaccttgaagttattaaagtccctgcctcagcctccatgcaaaaagaaacctgtttattaaaaaaaaaaaaaactttattaacatataatttgcataccataaaattaactcactgtaagtggttttcagtatattcccagagttgtgcagtcatcactacaatccagttatggagcatttctgtcaccccaaggagatcccacgtgtctgcttgcagacagttctcattcccactcccagccacaggcaaccactcatctgccttctgtctctctagattttccttttctgaacattttatataaatacaatcgcacaatagttagtcttttgcactggcttctgtcacatagcatgatgtttttgaagtttagaaaccagcttccatacaccaaattacaacatcagttcaagactgaatttagtcatctttcagc

SEQ ID NO: 298755 - DNA, 1263 bp, Homo sapiens
ccgggtccagcctgttgctgatgctgccgtgcggtacttgtcatggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagggcggtccaggcggttctagcactggatttggaaactttgaggaaattgggccccttgacagtgatctcaaaccacggaaaaccacctggctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatggaggaaaaatggcagctggcattggtctagagctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtctacaatggagtcgagtctagaattcacacagagccacctagctgaatctgaaaccctccctcttgctgtgcagcatccccagcagcttggtaaagatgtcctcatggccaggcgtggtggctcacacctgtaatcccaccacttgggaggctgaggcgggtggatcatgaggacaagagatcgagaccatcctggccaacatggtgaaaccctgtctctactaaaaatacaaaaatgagctgggcatggtggcgggtgcctgtagttccagctactcgggaggctgaggcaggaaaatcgcttgaacccaggaggcggaggtttcagtgagccgagatcgtgccactgcactccagcctggagacagagagagattctgtct

SEQ ID NO: 298756 - DNA, 1065 bp, Homo sapiens
gtcctcttggccttacttccagccctttgactcactatctaccagtttggttttttgtctttgtcagcgccacgtgagacacctacaacgagatgccttaagccagctcatgaatggccccatcagaaagaagctcaaaattattcctgaggatcaatcctggggaggccaggctaccaacgtctttgtgaacatggaggaggacttcatgaagccagtcattagcattgtggacgagttgctggaggcagggatcaacgtgacggtgtataatggacagctggatctcatcgtagataccatgggtcaggaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtgactcagcaagaataggatggatggggctggagatgagctggtttggccttggggcacagagctgagctgaggccgctgaagctgtaggaagcgccattcttccctgtatctaactggggctgtgatcaagaaggttctgaccagcttctgcagaggataaaatcattgtctctggaggcaatttggaaattatttctgcttcttaaaaaaacctaagattttttaaaaaattgatttgttttgatcaaaataaaggatgataatagatattattttttcttatgacagaagcaaatgatgtgatttatagaaaaactgggaaatacaggtacccaaagagtaaatcaacatctgtatacccccttcccaggggtaagcactgttaccaatttagcatatgtccttgcagaatttttttttctatatatacatatatattttttaccaaaatgaatcattactctatgttgttttactatttgtttgacatatcagtatatctgaaacaccttttcatgtcaataaatgttcttctctaacatttttaa

SEQ ID NO: 298757 - DNA, 924 bp, Homo sapiens
aagatcaacgtgaacggggtgtatggacagctggatctcatcgtagataacatgggaggaggacttcatgaagccagtcattagcattgtggacgagttgctggaggcagggatcaacgtgacggtgtataatggacagctggatctcatcgtagataccatgggtcaggaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtgactcagcaagaataggatggatggggctggagatgagctggtttggccttggggcacagagctgagctgaggccgctgaagctgtaggaagcgccattcttccctgtatctaactggggctgtgatcaagaaggttctgaccagcttctgcagaggataaaatcattgtctctggaggcaatttggaaattatttctgcttcttaaaaaaacctaagattttttaaaaaattgatttgttttgatcaaaataaaggatgataatagatattattttttcttatgacagaagcaaatgatgtgatttatagaaaaactgggaaatacaggtacccaaagagtaaatcaacatctgtatacccccttcccaggggtaagcactgttaccaatttagcatatgtccttgcagaatttttttttctatatatacatatatattttttaccaaaatgaatcattactctatgttgttttactatttgtttgacatatcagtatatctgaaacaccttttcatgtcaataaatgttcttctctaacatttttaa

SEQ ID NO: 298758 - DNA, 1069 bp, Homo sapiens
ccgggtccagcctgttgctgatgctgccgtgcggtacttgtcatggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagggcggtccaggcggttctagcactggatttggaaactttgaggaaattgggccccttgacagtgatctcaaaccacggaaaaccacctggctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatggaggaaaaatggcagctggcattggtctagagctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacaggtaaaaaggggaaacactcagaggcgagcctgcttggctttttctggtgggtacagggcccatggttggtgttgtcaaacttggagtctacactgaggctccccacatatctgcaaatgattgcatgctggataataaatctcttgggtctaagcagtgatgtagtggctccttacagagtcagaaagccacccaggcctgcaagacttgcttgtccttcactaaatgtatggattctatt

SEQ ID NO: 298759 - DNA, 434 bp, Homo sapiens
aagctactccctctttctccttccccatgtgcaggccaggctaccaacgtctttgtgaacatggaggaggacttcatgaagccagtcattagcattgtggacgagttgctggaggcagggatcaacgtgacggtgtataatggacagctggatctcatcgtagataccatgggtaggaattgactctgagaggcacctagaggcagttttatgggttcaactggaagggaactggccttggacatgtcagtcttgcggtgggtgatgttgaaatgccaggtggaaggccatttcccattacatccgtctaccccgaccttgattattcaaagggtggggagctgcacgtggctgtgacccctcagaagcctgagcctacctgggtttgggggcccttaggtatgattaaagaaaagaacaccacctgtctctac

SEQ ID NO: 298760 - DNA, 637 bp, Homo sapiens
gttggatcttcagggactttcaggatggcccggatcagctgtagcattgtgggtgattcctttcctcagagtttcaggttttttcagttacatctagagctgaaatctggatagtacctgcaggaacaatattcctgtagccatggaagagggccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaatggggctgaggcccctgtgtgatattgaaa

SEQ ID NO: 298761 - DNA, 1642 bp, Homo sapiens
tccgacccgccccgcggcgcattgtgggatctgtcggcttgtcaggtggtggaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacgactgtgagccacaacaccaagaggttccgctttgccctgcccaccgcccaccacactctggggctgcctgtgggcaaacatatctacctctccacccgaattgatggcagcctggtcatcaggccatacactcctgtcaccagtgatgaggatcaaggctatgtggatcttgtcatcaaggtctacctgaagggtgtgcaccccaaatttcctgagggagggaagatgtctcagtacctggatagcctgaaggttggggatgtggtggagtttcgggggccaagcgggttgctcacttacactggaaaagggcattttaacattcagcccaacaagaaatctccaccagaaccccgagtggcgaagaaactgggaatgattgccggcgggacaggaatcaccccaatgctacagctgatccgggccatcctgaaagtccctgaagatccaacccagtgctttctgctttttgccaaccagacagaaaaggatatcatcttgcgggaggacttagaggaactgcaggcccgctatcccaatcgctttaagctctggttcactctggatcatcccccaaaagattgggcctacagcaagggctttgtgactgccgacatgatccgggaacacctgcccgctccaggggatgatgtgctggtactgctttgtgggccacccccaatggtgcagctggcctgccatcccaacttggacaaactgggctactcacaaaagatgcgattcacctactgagcatcctccagcttccctggtgctgttcgctgcagttgttccccatcagtactcaagcactataagccttagattcctttcctcagagtttcaggttttttcagttacatctagagctgaaatctggatagtacctgcaggaacaatattcctgtagccatggaagagggccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaatggggctgaggcccctgtgtgatattgaaa

SEQ ID NO: 298762 - DNA, 1589 bp, Homo sapiens
tccgacccgccccgcggcgcattgtgggatctgtcggcttgtcaggtggtggaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacgactgtgagccacaacaccaagaggttccgctttgccctgcccaccgcccaccacactctggggctgcctgtgggcaaacatatctacctctccacccgaattgatggcagcctggtcatcaggccatacactcctgtcaccagtgatgaggatcaaggctatgtggatcttgtcatcaaggtctacctgaagggtgtgcaccccaaatttcctgagggagggaagatgtctcagtacctggatagcctgaaggttggggatgtggtggagtttcgggggccaagcgggttgctcacttacactggaaaagggcattttaacattcagcccaacaagaaatctccaccagaaccccgagtggcgaagaaactgggaatgattgccggcgggacaggaatcaccccaatgctacagctgatccgggccatcctgaaagtccctgaagatccaacccagtgctttctgctttttgccaaccagacagaaaaggatatcatcttgcgggaggacttagaggaactgcaggcccgctatcccaatcgctttaagctctggttcactctggatcatcccccaaaagattgggcctacagcaagggctttgtgactgccgacatgatccgggaacacctgcccgctccaggggatgatgtgctggtactgctttgtgggccacccccaatggtgcagctggcctgccatcccaacttggacaaactgggctactcactgcagttgttccccatcagtactcaagcactataagccttagattcctttcctcagagtttcaggttttttcagttacatctagagctgaaatctggatagtacctgcaggaacaatattcctgtagccatggaagagggccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaatggggctgaggcccctgtgtgatattgaaa

SEQ ID NO: 298763 - DNA, 1683 bp, Homo sapiens
tccgacccgccccgcggcgcattgtgggatctgtcggcttgtcaggtggtggaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacgactgtgagccacaacaccaagaggttccgctttgccctgcccaccgcccaccacactctggggctgcctgtgggcaaacatatctacctctccacccgaattgatggcagcctggtcatcaggccatacactcctgtcaccagtgatgaggatcaaggctatgtggatcttgtcatcaaggtctacctgaagggtgtgcaccccaaatttcctgagggagggaagatgtctcagtacctggatagcctgaaggttggggatgtggtggagtttcgggggccaagcgggttgctcacttacactggaaaagggcattttaacattcagcccaacaagaaatctccaccagaaccccgagtggcgaagaaactgggaatgattgccggcgggacaggaatcaccccaatgctacagctgatccgggccatcctgaaagtccctgaagatccaacccagtgctttctgctttttgccaaccagacagaaaaggatatcatcttgcgggaggacttagaggaactgcaggcccgctatcccaatcgctttaagctctggttcactctggatcatcccccaaaagattgggcctacagcaagggctttgtgactgccgacatgatccgggaacacctgcccgctccaggggatgatgtgctggtactgctttgtgggccacccccaatggtgcagctggcctgccatcccaacttggacaaactgggctactcacaaaagatgcgattcacctactgagcatcctccagcttccctggtgctgttcgctgcagttgttccccatcagtactcaagcactataagccttagattcctttcctcagagtttcaggttttttcagttacatctagagctgaaatctggatagtacctgcaggaacaatattcctgtagccatggaagagggccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaatggggctgaggcccctgtgtgatattgaaacttctaaaactaggggtaccggctcgattcgatctgtctgc

SEQ ID NO: 298764 - DNA, 1569 bp, Homo sapiens
tccgacccgccccgcggcgcattgtgggatctgtcggcttgtcaggtggtggaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacggcaaacatatctacctctccacccgaattgatggcagcctggtcatcaggccatacactcctgtcaccagtgatgaggatcaaggctatgtggatcttgtcatcaaggtctacctgaagggtgtgcaccccaaatttcctgagggagggaagatgtctcagtacctggatagcctgaaggttggggatgtggtggagtttcgggggccaagcgggttgctcacttacactggaaaagggcattttaacattcagcccaacaagaaatctccaccagaaccccgagtggcgaagaaactgggaatgattgccggcgggacaggaatcaccccaatgctacagctgatccgggccatcctgaaagtccctgaagatccaacccagtgctttctgctttttgccaaccagacagaaaaggatatcatcttgcgggaggacttagaggaactgcaggcccgctatcccaatcgctttaagctctggttcactctggatcatcccccaaaagattgggcctacagcaagggctttgtgactgccgacatgatccgggaacacctgcccgctccaggggatgatgtgctggtactgctttgtgggccacccccaatggtgcagctggcctgccatcccaacttggacaaactgggctactcacaaaagatgcgattcacctactgagcatcctccagcttccctggtgctgttcgctgcagttgttccccatcagtactcaagcactataagccttagattcctttcctcagagtttcaggttttttcagttacatctagagctgaaatctggatagtacctgcaggaacaatattcctgtagccatggaagagggccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaatggggctgaggcccctgtgtgatattgaaa

SEQ ID NO: 298765 - DNA, 1609 bp, Homo sapiens
atcgtcgacccacgcgtccgggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacgactgtgagccacaacaccaagaggttccgctttgccctgcccaccgcccaccacactctggggctgcctgtgggcaaacatatctacctctccacccgaattgatggcagcctggtcatcaggccatacactcctgtcaccagtgatgaggatcaaggctatgtggatcttgtcatcaaggtctacctgaagggtgtgcaccccaaatttcctgagggagggaagatgtctcagtacctggatagcctgaaggttggggatgtggtggagtttcgggggccaagcgggttgctcacttacactggaaaagggcattttaacattcagcccaacaagaaatctccaccagaaccccgagtggcgaagaaactgggaatgattgccggcgggacaggaatcaccccaatgctacagctgatccgggccatcctgaaagtccctgaagatccaacccagtgctttctgctttttgccaaccagacagaaaaggatatcatcttgcgggaggacttagaggaactgcaggcccgctatcccaatcgctttaagctctggttcactctggatcatcccccaaaagattgggcctacagcaagggctttgtgactgccgacatgatccgggaacacctgcccgctccaggggatgatgtgctggtactgctttgtgggccacccccaatggtgcagctggcctgccatcccaacttggacaaactgggctactcacaaaagatgcgattcacctactgagcatcctccagcttccctggtgctgttcgctgcagttgttccccatcagtactcaagcactataagccttagattcctttcctcagagtttcaggttttttcagttacatctagagctgaaatctggatagtacctgcaggaacaatattcctgtagccatggaagagggccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaatggggctgaggcccctgtgtgatattgaaa

SEQ ID NO: 298766 - DNA, 2616 bp, Homo sapiens
tccgacccgccccgcggcgcattgtgggatctgtcggcttgtcaggtggtggaggaaaaggcgctccgtcatggggatccagacggtaagaccctcattcagtatcctccactgggggacccctccccatctggttctggccactcagctccggaccaggggctgtcgctgccgaccccgccccgcagggctctgggcccaccgtggatgctggggtcccgatcccgcacatccgggctcgggactccgccaggttacccctctgcccttggcatgcctccgcgctggagctcgggatcgccacccctgggacggtcaccacccaagccccgggctcttacccagcctggcggtcacgctgcctcctctacccacagagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacggtaagttggggaagaaagggccagggtgaaggaggggaccagagtgctcctggcatggagggtacagcacccacggtggttgggatgtccaagggacgtggcagcgccaggcgcgcttggtgaaacacttgtgtcctccaccctccagactgtgagccacaacaccaagaggttccgctttgccctgcccaccgcccaccacactctggggctgcctgtgggtaaggaaagtgtggaatgggctcctttccctggtatcctcagaaggtgactcccctcctgggatctcatgaaacacgctgcttcaaccggtttgctccacacaccattccccttcccccacttggctctgcatcctccaagctgtgaggtgccactgggcccctctagagtgtggcttccatgacccccatccagctttaacactcaacagtcttgcctcttccctgcaggatttgctaattactccctctgagcaagcactactaactttttcccattgcccagacccttttggctcatctgtcaaggtcctggcagtaactggcaggaaacgctggaaataagtgtttcctcaactgggcgcttataagagatccaactgagggctcaatggggcaaatcttccctgccttgtagctccttgggaccacagcaggaagcaagacatcttgttctctcaaatctctttgagtattttgagggatgcagcacatcacagacaacccttatgtagctctctgcacggtccccaggcaaacatatctacctctccacccgaattgatggcagcctggtcatcaggccatacactcctgtcaccagtgatgaggatcaaggctatgtggatcttgtcatcaaggtctacctgaagggtgtgcaccccaaatttcctgagggagggaagatgtctcagtacctggatagcctgaaggttggggatgtggtggagtttcgggggccaagcgggttgctcacttacactggaaaagggcattttaacattcagcccaacaagaaatctccaccagaaccccgagtggcgaagaaactgggaatgattgccggcgggacaggaatcaccccaatgctacagctgatccgggccatcctgaaagtccctgaagatccaacccagtgctttctgctttttgccaaccagacagaaaaggatatcatcttgcgggaggacttagaggaactgcaggcccgctatcccaatcgctttaagctctggttcactctggatcatcccccaaaagattgggcctacagcaagggctttgtgactgccgacatgatccgggaacacctgcccgctccaggggatgatgtgctggtactgctttgtgggccacccccaatggtgcagctggcctgccatcccaacttggacaaactgggctactcacaaaagatgcgattcacctactgagcatcctccagcttccctggtgctgttcgctgcagttgttccccatcagtactcaagcactataagccttagattcctttcctcagagtttcaggttttttcagttacatctagagctgaaatctggatagtacctgcaggaacaatattcctgtagccatggaagagggccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaatggggctgaggcccctgtgtgatattgaaa

SEQ ID NO: 298767 - DNA, 1758 bp, Homo sapiens
tccgacccgccccgcggcgcattgtgggatctgtcggcttgtcaggtggtggaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacgactgtgagccacaacaccaagaggttccgctttgccctgcccaccgcccaccacactctggggctgcctgtggctccttgggaccacagcaggaagcaagacatcttgttctctcaaatctctttgagtattttgagggatgcagcacatcacagacaacccttatgtagctctctgcacggtccccaggcaaacatatctacctctccacccgaattgatggcagcctggtcatcaggccatacactcctgtcaccagtgatgaggatcaaggctatgtggatcttgtcatcaaggtctacctgaagggtgtgcaccccaaatttcctgagggagggaagatgtctcagtacctggatagcctgaaggttggggatgtggtggagtttcgggggccaagcgggttgctcacttacactggaaaagggcattttaacattcagcccaacaagaaatctccaccagaaccccgagtggcgaagaaactgggaatgattgccggcgggacaggaatcaccccaatgctacagctgatccgggccatcctgaaagtccctgaagatccaacccagtgctttctgctttttgccaaccagacagaaaaggatatcatcttgcgggaggacttagaggaactgcaggcccgctatcccaatcgctttaagctctggttcactctggatcatcccccaaaagattgggcctacagcaagggctttgtgactgccgacatgatccgggaacacctgcccgctccaggggatgatgtgctggtactgctttgtgggccacccccaatggtgcagctggcctgccatcccaacttggacaaactgggctactcacaaaagatgcgattcacctactgagcatcctccagcttccctggtgctgttcgctgcagttgttccccatcagtactcaagcactataagccttagattcctttcctcagagtttcaggttttttcagttacatctagagctgaaatctggatagtacctgcaggaacaatattcctgtagccatggaagagggccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaatggggctgaggcccctgtgtgatattgaaa

SEQ ID NO: 298768 - DNA, 1750 bp, Homo sapiens
taacgcggctggtccggccacggggttatgggctcaggtggtggaggcaccggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacgactgtgagccacaacaccaagaggttccgctttgccctgcccaccgcccaccacactctggggctgcctgtggctccttgggaccacagcaggaagcaagacatcttgttctctcaaatctctttgagtattttgagggatgcagcacatcacagacaacccttatgtagctctctgcacggtccccaggcaaacatatctacctctccacccgaattgatggcagcctggtcatcaggccatacactcctgtcaccagtgatgaggatcaaggctatgtggatcttgtcatcaaggtctacctgaagggtgtgcaccccaaatttcctgagggagggaagatgtctcagtacctggatagcctgaaggttggggatgtggtggagtttcgggggccaagcgggttgctcacttacactggaaaagggcattttaacattcagcccaacaagaaatctccaccagaaccccgagtggcgaagaaactgggaatgattgccggcgggacaggaatcaccccaatgctacagctgatccgggccatcctgaaagtccctgaagatccaacccagtgctttctgctttttgccaaccagacagaaaaggatatcatcttgcgggaggacttagaggaactgcaggcccgctatcccaatcgctttaagctctggttcactctggatcatcccccaaaagattgggcctacagcaagggctttgtgactgccgacatgatccgggaacacctgcccgctccaggggatgatgtgctggtactgctttgtgggccacccccaatggtgcagctggcctgccatcccaacttggacaaactgggctactcacaaaagatgcgattcacctactgagcatcctccagcttccctggtgctgttcgctgcagttgttccccatcagtactcaagcactataagccttagattcctttcctcagagtttcaggttttttcagttacatctagagctgaaatctggatagtacctgcaggaacaatattcctgtagccatggaagagggccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaatggggctgaggcccctgtgtgatattgaaa

SEQ ID NO: 298769 - DNA, 2008 bp, Homo sapiens
tccgacccgccccgcggcgcattgtgggatctgtcggcttgtcaggtggtggaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacgactgtgagccacaacaccaagaggttccgctttgccctgcccaccgcccaccacactctggggctgcctgtgggcaaacatatctacctctccacccgaattgatggcagcctggtcatcaggccatacactcctgtcaccagtgatgaggatcaaggctatgtggatcttgtcatcaaggtctacctgaagggtgtgcaccccaaatttcctgagggagggaagatgtctcagtacctggatagcctgaaggttggggatgtggtggagtttcgggggccaagcgggttgctcacttacactggaaaagggcattttaacattcagcccaacaagaaatctccaccagaaccccgagtggcgaagaaactgggaatgattgccggcgggacaggaatcaccccaatgctacagctgatccgggccatcctgaaagtccctgaagatccaacccagtgctttctgctttttgccaaccagacagaaaaggatatcatcttgcgggaggacttagaggaactgcaggcccgctatcccaatcgctttaagctctggttcactctggatcatcccccaaaaggtatccttcccatttttggacatcccactatcccctcatcgtcaaaatcaaagccttgcccctttgtgaattctggcttcattgaaatcaaccttgcctcacactgccaactcggaagtttgagtgcacagacacagtgatctcctggtccctttcctttgggttcctgtttaccaggtgggtgacagggatggcggtgctgctaaggctcagcttgaggcaggctgagtatacccattcccagctgctgctaccacttgacactttctccagagcctttcagggccctccccagtctcatggcaccacacccccttgccagcatgtatctggagtattaagtactttcttctccccatacttcagattgggcctacagcaagggctttgtgactgccgacatgatccgggaacacctgcccgctccaggggatgatgtgctggtactgctttgtgggccacccccaatggtgcagctggcctgccatcccaacttggacaaactgggctactcacaaaagatgcgattcacctactgagcatcctccagcttccctggtgctgttcgctgcagttgttccccatcagtactcaagcactataagccttagattcctttcctcagagtttcaggttttttcagttacatctagagctgaaatctggatagtacctgcaggaacaatattcctgtagccatggaagagggccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaatggggctgaggcccctgtgtgatattgaaa

SEQ ID NO: 298770 - DNA, 835 bp, Homo sapiens
tccgacccgccccgcggcgcattgtgggatctgtcggcttgtcaggtggtggaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtactgcagttgttccccatcagtactcaagcactataagccttagattcctttcctcagagtttcaggttttttcagttacatctagagctgaaatctggatagtacctgcaggaacaatattcctgtagccatggaagagggccaaggctcagtcactccttggatggcctcctaaatctccccgtggcaacaggtccaggagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaatggggctgaggcccctgtgtgatattgaaa

SEQ ID NO: 298771 - DNA, 495 bp, Homo sapiens
  misc_feature (23)..(23): n is a, c, g, or t
  misc_feature (28)..(28): n is a, c, g, or t
gccacggtagataaggaggcatncaagnagtgactgagccttggcctcttccatggctacaggaatattgagaggcccatggagcagtctcttccatggagtaagaaggaagggagcatgtacgcttggtccaagattggctagttccttgatagcatcttactctcaccttctttgtgtctgtgatgaaaggaacagtctgtgcaatgggttttacttaaacttcactgttcaacctatgagcaaatctgtatgtgtgagtataagttgagcatagcatacttccagaggtggtcttatggagatggcaagaaaggaggaaatgatttcttcagatctcaaaggagtctgaaatatcatatttctgtgtgtgtctctctcagcccctgcccaggctagagggaaacagctactgataatcgaaaactgctgtttgtggcaggaacccctggctgtgcaaataaatggggctgaggcccctgtgtgatattgaaa

SEQ ID NO: 298772 - DNA, 1626 bp, Homo sapiens
tccgacccgccccgcggcgcattgtgggatctgtcggcttgtcaggtggtggaggaaaaggcgctccgtcatggggatccagacggtaagaccctcattcagtatcctccactgggggacccctccccatctggttctggccactcagctccggaccaggggctgtcgctgccgaccccgccccgcagggctctgggcccaccgtggatgctggggtcccgatcccgcacatccgggctcgggactccgccaggttacccctctgcccttggcatgcctccgcgctggagctcgggatcgccacccctgggacggtcaccacccaagccccgggctcttacccagcctggcggtcacgctgcctcctctacccacagagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacggtaagttggggaagaaagggccagggtgaaggaggggaccagagtgctcctggcatggagggtacagcacccacggtggttgggatgtccaagggacgtggcagcgccaggcgcgcttggtgaaacacttgtgtcctccaccctccagactgtgagccacaacaccaagaggttccgctttgccctgcccaccgcccaccacactctggggctgcctgtgggtaaggaaagtgtggaatgggctcctttccctggtatcctcagaaggtgactcccctcctgggatctcatgaaacacgctgcttcaaccggtttgctccacacaccattccccttcccccacttggctctgcatcctccaagctgtgaggtgccactgggcccctctagagtgtggcttccatgacccccatccagctttaacactcaacagtcttgcctcttccctgcaggatttgctaattactccctctgagcaagcactactaactttttcccattgcccagacccttttggctcatctgtcaaggtcctggcagtaactggcaggaaacgctggaaataagtgtttcctcaactgggcgcttataagagatccaactgagggctcaatggggcaaatcttccctgccttgtagctccttgggaccacagcaggaagcaagacatcttgttctctcaaatctctttgagtattttgagggatgcagcacatcacagacaacccttatgtagctctctgcacggtccccaggcaaacatatctacctctccacccgaattgatggcagcctggtcatcaggccatacactcctgtcaccagtgatgaggatcaaggctatgtggatcttgtcatcaaggtaaggggctaggaagggacccaggggctgcttacccattctttctgggatttgtagaaatttctaagatttgcctgacagcaggaaatggtatgtactctgtggatgtgaagaaagtatgagctactcaggagactgaggcaggagactcacttgaacccaggaggcggaggttgcagtgagccaagattgcgccactgcactcaagcctgggcagcaagagcaaaactctgactc

SEQ ID NO: 298773 - DNA, 989 bp, Homo sapiens
tccgacccgccccgcggcgcattgtgggatctgtcggcttgtcaggtggtggaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacgactgtgagccacaacaccaagaggttccgctttgccctgcccaccgcccaccacactctggggctgcctgtgggcaaacatatctacctctccacccgaattgatggcagcctggtcatcaggccatacactcctgtcaccagtgatgaggatcaaggctatgtggatcttgtcatcaaggtctacctgaagggtgtgcaccccaaatttcctgagggagggaagatgtctcagtacctggatagcctgaaggttggggatgtggtggagtttcgggggccaagcgggttgctcacttacactggaaaagggcattttaacattcagcccaacaagaaatctccaccagaaccccgagtggcgaagaaactgggaatgattgccggcgggacaggtgcattacactgagggcctttctctcccaccattgttgactgttgccatgcaaattcctaggtgaccctctgaagactggtaaccatagccaagctgttgttcatcaggggatttccagcaatgcttagaactccctagtatctgaaaaacaaaatcataagcaggtagaaaccaaaaaaaattttaactgatggaattagagaaacaaattaaatgagctttcctcattttgaatggatctaatagttttaggtgagagaagagagaagcagctaggaatgactagctaggaagaaagaaaattagcattggacactactgtgcattagacactgtgtagtctaatacactactatat

SEQ ID NO: 298774 - DNA, 546 bp, Homo sapiens
gcatcgacccactgtgtccagcccacatatttctttctgtgtatatttatacttacagcataagtataatttcttttaaaaaccactttcttcataaatatcttcagctgtgaagtaaaactatcaggtaagagatggagacagtcatttgtgtgtacatacaccacacacacaaactaacacacacacacataaaatttatggcatgtggttgtgcagtgctgttcaatcaaggcctccagaacttatatcacattctgagtatgatgtagtttatatggacagctaagtggttaattaatttcttcaatgaaactgtattgaacactgagcacttaagtgcaaagcacttaagtatagtagtgaacaagtgtttctgctcgcgcagaactcacaactgattaggggtaaggatgagaaaatcaggtgtgataaatgctgtgctagggggagcatagagttttatgggaacacataggaaggaaatctaagtcagatttggagagtcggagtggacttcctgatagtgacatctaagctaacctg

SEQ ID NO: 298775 - DNA, 552 bp, Homo sapiens
tcggcatcttggcaacatatttatgtttaagggacttaaggttaaaaggtttttgtctggcctgggaacactctatcttccctagggtttggaggtttggggaaaacttttaacaacttatcaaatatttgcaattagccattttttggagaacaaattgttactgagaatgtcataggaaatgttccctataagctgcatgctaccattactctcctgcttcttatgataatctctttagccacctagcttcatgtggtagaaagttattattttctataaagaaagaagaatgtggttcgagttcttgtaactacttctcccaaagttggaactacacagaatgactgaataagcagaatgcaaaattggggtttaattgattttgtgtgtgctgtttccaaggaccacttagtgggcccattcttatagctagaaatcgacaatatcgggagtgtttacacaaggaagtaggccttctcctacttcccacccttcagagatgagagactgctattatccatttaccagcgcaccactggaaagaatagt

SEQ ID NO: 298776 - DNA, 267 bp, Homo sapiens
ggaggttgcagtgagccgagatcacaccacttgcactccagcctgggcaatagagcgaaacttagtctcaaaaaaaaaaaaaaacaaaaaaaaacaaatgtaggcttggagctgccggtggccatctagctgtcagaaggcaagaagagatttgaaaataaggcccaggccaggcgcggtggctcacacctgtaatcccagcactttgagaggccgaggccggcggataacctgaggtcaggagttccagaccagactggccaacat

SEQ ID NO: 298777 - DNA, 1594 bp, Homo sapiens
ctggactgccgcgggggattctgggccaagatggcagcaatgaggaaggcgcttccgcggcgactggtgggcttggcgtccctccgggctgtcagcacctcatctatgggcactttaccaaagcgggtgaaaattgtggaagttggtccccgagatggactacaaaatgaaaagaatatcgtatctactccagtgaaaatcaagctgatagacatgctttctgaagcaggactctctgttatagaaaccaccagctttgtgtctcctaagtgggttccccagatgggtgaccacactgaagtcttgaagggcattcagaagtttcctggcatcaactacccagtcctgaccccaaatttgaaaggcttcgaggcagcggttgctgctggagccaaggaagtagtcatctttggagctgcctcagagctcttcaccaagaagaacatcaattgttccatagaggagagttttcagaggtttgacgcaatcctgaaggcagcgcagtcagccaatatttctgtgcgggggtacgtctcctgtgctcttggctgcccttatgaagggaagatctccccagctaaagtagctgaggtcaccaagaagttctactcaatgggctgctacgagatctccctgggggacaccattggtgtgggcaccccagggatcatgaaagacatgctgtctgctgtcatgcaggaagtgcctctggctgccctggctgtccactgccatgacacctatggtcaagccctggccaacaccttgatggccctgcagatgggagtgagtgtcgtggactcttctgtggcaggacttggaggctgtccctacgcacagggggcatcaggaaacttggccacagaagacctggtctacatgctagagggcttgggcattcacacgggtgtgaatctccagaagcttctggaagctggaaactttatctgtcaagccctgaacagaaaaactagctccaaagtggctcaggctacctgtaaactctgagccccttgcccacctgaagccctggggatgatgtggaaataggggcacacacagatgattcatggatggggacatggaaatgagaataggttaaatggtgcaggtacctcatagccagctctacacagaggtctctcctggcagaaagcaggcgaagggcaggaggagctgcttggcagaaggacctcctgcccagacctgaggagtgagaggctttgagggctgaagtctccctttgttacggaccctggcccaggagttgaatgcctgaggacgtgtgggaaccccgttccctacttagcatgatccttgagtctcctctctggatggaatccgcgagctggccacctggccaccctctacacggctccaccctgccatggccgtggggcccttgctctctgacttctcaggacacaggtcatggaggttcttcccaagctggcagaggccatttgtggaaagtggagagctacgtggtggccatctgccaactccagcatctctggaaaatctccacgctgaatgtgatttttgaaaacagcttatgtaattaaaggttgaatggcacatcataattccagca

SEQ ID NO: 298778 - DNA, 2020 bp, Homo sapiens
ctggactgccgcgggggattctgggccaagatggcagcaatgaggaaggcgcttccgcggcgactggtgggcttggcgtccctccgggctgtcagcacctcatctatgggcactttaccaaagcgggtgaaaattgtggaagttggtccccgagatggactacaaaatgaaaagaatatcgtatctactccagtgaaaatcaagctgatagacatgctttctgaagcaggactctctgttatagaaaccaccagctttgtgtctcctaagtgggttccccagatgggtgaccacactgaagtcttgaagggcattcagaagtttcctggcatcaactacccagtcctgaccccaaatttgaaaggcttcgaggcagcggttgctgctggagccaaggaagtagtcatctttggagctgcctcagagctcttcaccaagaagaacatcaattgttccatagaggagagttttcagaggtttgacgcaatcctgaaggcagcgcagtcagccaatatttctgtgcgggggtacgtctcctgtgctcttggctgcccttatgaagggaagatctccccagctaaagtagctgaggtgtgtgcatgtgtcagggcggggggtttggtgagggttggccaccttgtctgcccctgagcgcataggttcctctccccaccctttctggcaggttcctgacttcattcattcacccagctccttcattaagctcctgctgtgagcacagccctgcacttgctccctagaggcccccctcctagccgaacatgtagtccttgaagcccctggcctctatccagcctgaaaacctccaattcagtttccagtctggtcgttgaggtgattctctgaggaggggctccttacccaggagttcccatagttccttgtagtgattgaaaggccacaaccctgatgtcctctgaacagtcaccaggtcaacactgagaagaacatggcatgggaattgagtttgaccagcccaagaacttatgtcatttagtcctcaaaaccactgtgcaaatttggtattattattcccttttacagttgagaaaactgacactaaataacttgccacacaggttacaaatggtgaaatcaggtatcaaaccccattttttctctctccaaagcccacttcttcccaggatactttgtggcatccagataggtggaatggtaacagtagcaactgtttcttgagagcagctgccctgctccaggtcttagcctcagttgccacaatccttgccatatgaccaaagggtcatcaccatttttcagaagcagaaattgaagctcagaaaagtgaagttgcttgccaaggcccacagctagtgaacagcagaactaggactttaacccagcatctcgtgacttcaaaggcctgctccttcccctgcaccctgctgccccctaaaggccagccactgccgccccacactctgcagggccactggggaagcgacgtcaccatttcatttatttagcagatcactggtgtcttctggtcccctttccctgccacatccctctgcaccttgtccagcagccccgtgtgggcagcagctccttgggtgaggccatctttttttaagttcaccagtcgtatgggattaggggcccaccctattccagtatggcttattccaattggacccatattggacctattccaatatggacccattttgcagtggttttagagatgtgcaaatgggcttccaaaaatttaaatagtgatgtacctctattaaaaaatataactattggccgggcacggtggctcacgcctgtaatcccagcactttgggaggctgagatgggcagatcacaaggtcaggagatcgagaccatcctggctaacatggtgcaaccccgtctctactaaaaatacaaaaaattagccgggggtggtggtgggcgccggtagtcccagctactcgggaggctgagaaaggagaatggcgtgaacccgggaggcggagcttgcagtgagctg

SEQ ID NO: 298779 - DNA, 1597 bp, Homo sapiens
ctgaattgtgccgaattcggcacgagctccgcccagctgcaggtgttgattgcacactgatcagaaatgtgtgttaaacagccctgcctcagttctgctagccagtacgtctcctgtgctcttggctgcccttatgaagggaagatctccccagctaaagtagctgaggtgtgtgcatgtgtcagggcggggggtttggtgagggttggccaccttgtctgcccctgagcgcataggttcctctccccaccctttctggcaggttcctgacttcattcattcacccagctccttcattaagctcctgctgtgagcacagccctgcacttgctccctagaggcccccctcctagccgaacatgtagtccttgaagcccctggcctctatccagcctgaaaacctccaattcagtttccagtctggtcgttgaggtgattctctgaggaggggctccttacccaggagttcccatagttccttgtagtgattgaaaggccacaaccctgatgtcctctgaacagtcaccaggtcaacactgagaagaacatggcatgggaattgagtttgaccagcccaagaacttatgtcatttagtcctcaaaaccactgtgcaaatttggtattattattcccttttacagttgagaaaactgacactaaataacttgccacacaggttacaaatggtgaaatcaggtatcaaaccccattttttctctctccaaagcccacttcttcccaggatactttgtggcatccagataggtggaatggtaacagtagcaactgtttcttgagagcagctgccctgctccaggtcttagcctcagttgccacaatccttgccatatgaccaaagggtcatcaccatttttcagaagcagaaattgaagctcagaaaagtgaagttgcttgccaaggcccacagctagtgaacagcagaactaggactttaacccagcatctcgtgacttcaaaggcctgctccttcccctgcaccctgctgccccctaaaggccagccactgccgccccacactctgcagggccactggggaagcgacgtcaccatttcatttatttagcagatcactggtgtcttctggtcccctttccctgccacatccctctgcaccttgtccagcagccccgtgtgggcagcagctccttgggtgaggccatctttttttaagttcaccagtcgtatgggattaggggcccaccctattccagtatggcttattccaattggacccatattggacctattccaatatggacccattttgcagtggttttagagatgtgcaaatgggcttccaaaaatttaaatagtgatgtacctctattaaaaaatataactattggccgggcacggtggctcacgcctgtaatcccagcactttgggaggctgagatgggcagatcacaaggtcaggagatcgagaccatcctggctaacatggtgcaaccccgtctctactaaaaatacaaaaaattagccgggggtggtggtgggcgccggtagtcccagctactcgggaggctgagaaaggagaatggcgtgaacccgggaggcggagcttgcagtgagctg

SEQ ID NO: 298780 - DNA, 382 bp, Homo sapiens
gtctcccttggttcctagatgggtgaccacactgaagtcttgaagggcattcagaagtttcctggcatcaactacccagtcctgaccccaaatttgaaaggcttcgaggcagcggttgctgctggagccaaggaagtagtcatctttggagctgcctcagagcttccaccctgccatggccgtggggcccttgctctctgacttctcaggacacaggtcatggaggttcttcccaagctggcagaggccatttgtggaaagtggagagctacgtggtggccatctgccaactccagcatctctggaaaatctccacgctgaatgtgatttttgaaaacagcttatgtaattaaaggttgaatggcacatcataattccagca

SEQ ID NO: 298781 - DNA, 1445 bp, Homo sapiens
ctggactgccgcgggggattctgggccaagatggcagcaatgaggaaggcgcttccgcggcgactggtgggcttggcgtccctccgggctgtcagcacctcatctatgggcactttaccaaagcgggtgaaaattgtggaagttggtccccgagatggactacaaaatgaaaagaatatcgtatctactccagtgaaaatcaagctgatagacatgctttctgaagcaggactctctgttatagaaaccaccagctttgtgtctcctaagtgggttccccagatgggtgaccacactgaagtcttgaagggcattcagaagtttcctggcatcaactacccagtcctgaccccaaatttgaaaggcttcgaggcagcggtacgtctcctgtgctcttggctgcccttatgaagggaagatctccccagctaaagtagctgaggtcaccaagaagttctactcaatgggctgctacgagatctccctgggggacaccattggtgtgggcaccccagggatcatgaaagacatgctgtctgctgtcatgcaggaagtgcctctggctgccctggctgtccactgccatgacacctatggtcaagccctggccaacaccttgatggccctgcagatgggagtgagtgtcgtggactcttctgtggcaggacttggaggctgtccctacgcacagggggcatcaggaaacttggccacagaagacctggtctacatgctagagggcttgggcattcacacgggtgtgaatctccagaagcttctggaagctggaaactttatctgtcaagccctgaacagaaaaactagctccaaagtggctcaggctacctgtaaactctgagccccttgcccacctgaagccctggggatgatgtggaaataggggcacacacagatgattcatggatggggacatggaaatgagaataggttaaatggtgcaggtacctcatagccagctctacacagaggtctctcctggcagaaagcaggcgaagggcaggaggagctgcttggcagaaggacctcctgcccagacctgaggagtgagaggctttgagggctgaagtctccctttgttacggaccctggcccaggagttgaatgcctgaggacgtgtgggaaccccgttccctacttagcatgatccttgagtctcctctctggatggaatccgcgagctggccacctggccaccctctacacggctccaccctgccatggccgtggggcccttgctctctgacttctcaggacacaggtcatggaggttcttcccaagctggcagaggccatttgtggaaagtggagagctacgtggtggccatctgccaactccagcatctctggaaaatctccacgctgaatgtgatttttgaaaacagcttatgtaattaaaggttgaatggcacatcataattccagca

SEQ ID NO: 298782 - DNA, 1381 bp, Homo sapiens
ctggactgccgcgggggattctgggccaagatggcagcaatgaggaaggcgcttccgcggcgactggtgggcttggcgtccctccgggctgtcagcacctcatctatgggcactttaccaaagcgggtgaaaattgtggaagttggtccccgagatggactacaaaatgaaaagaatatcgtatctactccagtgaaaatcaagctgatagacatgctttctgaagcaggactctctgttatagaaaccaccagctttgtgtctcctaagtgggttccccagatgggtgaccacactgaagtcttgaagggcattcagaagtttcctggcatcaactacccagtcctgaccccaaatttgaaaggcttcgaggcagcggtcaccaagaagttctactcaatgggctgctacgagatctccctgggggacaccattggtgtgggcaccccagggatcatgaaagacatgctgtctgctgtcatgcaggaagtgcctctggctgccctggctgtccactgccatgacacctatggtcaagccctggccaacaccttgatggccctgcagatgggagtgagtgtcgtggactcttctgtggcaggacttggaggctgtccctacgcacagggggcatcaggaaacttggccacagaagacctggtctacatgctagagggcttgggcattcacacgggtgtgaatctccagaagcttctggaagctggaaactttatctgtcaagccctgaacagaaaaactagctccaaagtggctcaggctacctgtaaactctgagccccttgcccacctgaagccctggggatgatgtggaaataggggcacacacagatgattcatggatggggacatggaaatgagaataggttaaatggtgcaggtacctcatagccagctctacacagaggtctctcctggcagaaagcaggcgaagggcaggaggagctgcttggcagaaggacctcctgcccagacctgaggagtgagaggctttgagggctgaagtctccctttgttacggaccctggcccaggagttgaatgcctgaggacgtgtgggaaccccgttccctacttagcatgatccttgagtctcctctctggatggaatccgcgagctggccacctggccaccctctacacggctccaccctgccatggccgtggggcccttgctctctgacttctcaggacacaggtcatggaggttcttcccaagctggcagaggccatttgtggaaagtggagagctacgtggtggccatctgccaactccagcatctctggaaaatctccacgctgaatgtgatttttgaaaacagcttatgtaattaaaggttgaatggcacatcataattccagca

SEQ ID NO: 298783 - DNA, 1679 bp, Homo sapiens
ctggactgccgcgggggattctgggccaagatggcagcaatgaggaaggcgcttccgcggcgactggtgggcttggcgtccctccgggctgtcagcacctcatctatgggcactttaccaaagcgggtgaaaattgtggaagttggtccccgagatggactacaaaatgaaaagaatatcgtatctactccagtgaaaatcaagctgatagacatgctttctgaagcaggactctctgttatagaaaccaccagctttgtgtctcctaagtgggttccccagatgggtgaccacactgaagtcttgaagggcattcagaagtttcctggcatcaactacccagtcctgaccccaaatttgaaaggcttcgaggcagcggttgctgctggagccaaggaagtagtcatctttggagctgcctcagagctcttcaccaagaagaacatcaattgttccatagaggagagttttcagaggtttgacgcaatcctgaaggcagcgcagtcagccaatatttctgtgcgggggtacgtctcctgtgctcttggctgcccttatgaagggaagatctccccagctaaagtagctgaggtcaccaagaagttctactcaatgggctgctacgagatctccctgggggacaccattggtgtgggcaccccagggatcatgaaagacatgctgtctgctgtcatgcaggaagtgcctctggctgccctggctgtccactgccatgacacctatggtcaagccctggccaacaccttgatggccctgcagatgggagtgagtgtcgtggactcttctgtggcaggacttggaggctgtccctacgcacagggggcatcaggaaacttggccacagaagacctggtctacatgctagagggcttgggcattcacacgggtgtgaatctccagaagcttctggaagctggaaactttatctgtcaagccctgaacagaaaaactagctccaaagtggctcaggctacctgtaaactctgagccccttgcccacctgaagccctggggatgatgtggaaataggggcacacacagatgattcatggatggggacatggaaatgagaataggttaaatggtgcaggtacctcatagccagctctacacagaggtctctcctggcagaaagcaggcgaagggcaggaggagctgcttggcagaaggacctcctgcccagacctgaggagtgagaggctttgagggctgaagtctccctttgttacggaccctggcccaggagttgaatgcctgaggacgtgtgggaaccccgttccctacttagcatgatccttgagtctcctctctggatggaatccgcgaaggaaacttggccacagaagacctggtctacatgctagagggcttgggcattcacacgggtcgtgaatctccagaagcttccggaagctgcgataccttatattgccgaatcactgatctgacacagtagccccctattgcctcaatttagcatgtcgactccgatccccttgcccacctgaagccctggggatgatgtggaaataggggcacacacagatgattcatggatggggacatggaaatgagaataggttaaatggtgcagtacctcatagccagctctacacagagtctctcctgcagcagcgcgaagtgcattgcggtacccg

SEQ ID NO: 298784 - DNA, 1253 bp, Homo sapiens
ctggactgccgcgggggattctgggccaagatggcagcaatgaggaaggcgcttccgcggcgactggtgggcttggcgtccctccgggctgtcagcacctcatctatgggcactttaccaaagcgggtgaaaattgtggaagttggtccccgagatggactacaaaatgaaaagaatatcgtatctactccagtgaaaatcaagctgatagacatgctttctgaagcaggactctctgttatagaaaccaccagctttgtgtctcctaagtgggttccccagatgggtgaccacactgaagtcttgaagggcattcagaagtttcctggcatcaactacccagtcctgaccccaaatttgaaaggcttcgaggcagcggttgctgctggagccaaggaagtagtcatctttggagctgcctcagagctcttcaccaagaagaacatcaattgttccatagaggagagttttcagaggtttgacgcaatcctgaaggcagcgcagtcagccaatatttctgtgcgggggtacgtctcctgtgctcttggctgcccttatgaagggaagatctccccagctaaagtagctgaggtcaccaagaagttctactcaatgggctgctacgagatctccctgggggacaccattggtgtgggcaccccagggatcatgaaagacatgctgtctgctgtcatgcaggaagtgcctctggctgccctggctgtccactgccatgacacctatggtcaagccctggccaacaccttgatggccctgcagcttactgtgataccctgccctggttcctgggctttccttcagctcatgcgtttcccagccaggcagacaggaagagtgacttcctctcctatgccttgccaggcaggtaaaggggaattctgcacagctgagggaacaggttgagctgtgtgacgtctggcagtagcttcctctgacctccctcttccatcagttacttcggaaatatggatcgatgtgccaggttaagtgctgacttagacaatggtaacaagacccaatccctgccctctgggagctcatgttatggtgggtggggaagacagatggaagattacaggcgtgtaaatagcacattgtaagaccatttattcacctattaaaacctaacctaacggtgcctagtgtgctaggcactgttctcagcattaaggattcagctgtgaccaaaacagagtctctgccctcatgaggctgacactctagtactatga

SEQ ID NO: 298785 - DNA, 947 bp, Homo sapiens
ctggactgccgcgggggattctgggccaagatggcagcaatgaggaaggcgcttccgcggcgactggtgggcttggcgtccctccgggctgtcagcacctcatctatgggcactttaccaaagcgggtgaaaattgtggaagttggtccccgagatggactacaaaatgaaaagaatatcgtatctactccagtgaaaatcaagctgatagacatgctttctgaagcaggactctctgttatagaaaccaccagctttgtgtctcctaagtgggttccccagatgggtgaccacactgaagtcttgaagggcattcagaagtttcctggcatcaactacccagtcctgaccccaaatttgaaaggcttcgaggcagcggtaagaggatagcttgttggtgggggctcctgaaatgagattgatggcattggtccctgccttgtcttggcgcctcagtcccctgtcctgggatgtccatctgaatagcttgtctgtcagccagaccctggggcaaacctggccctgccactcactgctctgtgatcttgacaagttgacaagcctataaaatagggctaaatgatagtacctgaagttgtgagcatttcagaagataggatgcatgtacattgcttagcaagagccagataaaaggtaactgcttaataaatgttagctcttttgattatccacttctttagagaaatgtaaccaaactctccacaagagtttcaacagtagttgctggcatctgccaactttcttacaattttagacaagaacatctttggaggcgttggttctgtatttaggcaaaaacctttttttggctgggcacagtggctcacacctataatcccagcactttgggaggctgaggccggagaacagcttgaggccagaagcttgagaccagcctgagcaacataaggagaccttgtctctac

SEQ ID NO: 298786 - DNA, 776 bp, Homo sapiens
ctggactgccgcgggggattctgggccaagatggcagcaatgaggaaggcgcttccgcggcgactggtgggcttggcgtccctccgggctgtcagcacctcatctatgggcactttaccaaagcgggtgaaaattgtggaagttggtccccgagatggactacaaaatgaaaagaatatcgtatctactccagtgaaaatcaagctgatagacatgctttctgaagcaggactctctgttatagaaaccaccagctttgtgtctcctaagtgggttccccagatgggtgaccacactgaagtcttgaagggcattcagaagtttcctggcatcaactacccagtcctggccctgccactcactgctctgtgatcttgacaagttgacaagcctataaaatagggctaaatgatagtacctgaagttgtgagcatttcagaagataggatgcatgtacattgcttagcaagagccagataaaaggtaactgcttaataaatgttagctcttttgattatccacttctttagagaaatgtaaccaaactctccacaagagtttcaacagtagttgctggcatctgccaactttcttacaattttagacaagaacatctttggaggcgttggttctgtatttaggcaaaaacctttttttggctgggcacagtggctcacacctataatcccagcactttgggaggctgaggccggagaacagcttgaggccagaagcttgagaccagcctgagcaacataaggagaccttgtctctac

SEQ ID NO: 298787 - DNA, 637 bp, Homo sapiens
gccgaattcggcacgagctccgcccagctgcaggtgttgattgcacactgatcagaaatgtgtgttaaacagccctgcctcagttctgctagccaaaaagctcaggacactgacctcattcctcccctgtcttcccacagggtacgtctcctgtgctcttggctgcccttatgaagggaagatctccccagctaaagtagctgaggtgtgtgcatgtgtcagggcggggggtttggtgagggttggccaccttgtctgcccctgagcgcataggttcctctccccaccctttctggcaggttcctgacttcattcattcacccagctccttcattaagctcctgctgtgagcacagccctgcacttgctccctagaggcccccctcctagccgaacatgtagtccttgaagcccctggcctctatccagcctgaaaacctccaattcagtttccagtctggtcgttgaggtgattctctgaggaggggctccttacccaggagttcccatagttccttgtagtgattgaaaggccacaaccctgatgtcctctgaacagtcaccaggtcaacactgagaagaacatggcatgggaattgagtttgaccagcccaagaacttatgtcatttagtcctc

SEQ ID NO: 298788 - DNA, 263 bp, Homo sapiens
gggggattctgggccaagatggcagcaatgaggaaggcgcttccgcggcgactggtgggcttggcgtccctccgggctgtaagtgccccgagccgccgaggcggcggccctgcaggcactctgactgtcagggttgggggcttggcccgtggtgactgctctcttagaggcgaggccggacagctctcaggccagagtcgggagggcgttggagtcctggaccctcccttttcccctcaaatcctttgaaggggatgggaaaa

SEQ ID NO: 298789 - DNA, 187 bp, Homo sapiens
gtgtgcttgcctagctgagggatgggtcaccttttccttctcagaacgtagtaaatacctagatccctctaggatggaagatggcgaggtagagagaactatacgaggccgcctgcccagcttgtagatgggcccaccttccagtgcagggtaatgtgtgtgaatgggctgtgcaggtccccagaac

SEQ ID NO: 298790 - DNA, 574 bp, Homo sapiens
cgcggctgactcttgaggatcccttccatgtggacttagagcgggagctggcagacctccatgggaaagatgccgcactcttgttttcctcgtgctttgtggccaatgactcaaccctcttcaccctggctaagatgatgccaggtaaggaagcctggcatgagtgccttcgagtttttggggtttcttagtaataacaagaatatgggcaacaaagaagccttaccagaacctctcaattgaaaatcataatcctatctgggcattggttctggggtcaagcatgaaatgctgactgtacattatgggctccaggagaacgtgataccagtgaaaattcaaacttgaaacgtctcatccttgagctaattgcctcaaatatgttttgtattctaagatgatcctttggagaagtctcttaatcatttagttagctcttgattgagtttggagtgaggcagtcagatttaagagcagattaatggcctgccacaaggttattctacacctttgggccttctcacaagggaagcactaactagttattttgccaggaagaaactggcacacagtg

SEQ ID NO: 298791 - DNA, 2237 bp, Homo sapiens
gctgtatattaaggcgccggcgatcgcggcctgaggctgctcccggacaagggcaacgagcgtttcgtttggacttctcgacttgagtgcccgcctccttcgccgccgcctctgcagtcctcagcgcagtctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtgaatctt

SEQ ID NO: 298792 - DNA, 2217 bp, Homo sapiens
  misc_feature (16)..(16): n is a, c, g, or t
ggacgcgtgggtcganccacgcgtcgcggacgcgtgggagcgtttcgtttggacttctcgacttgagtgcccgcctccttcgccgccgcctctgcagtcctcagcgcagtctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtgaatctt

SEQ ID NO: 298793 - DNA, 2803 bp, Homo sapiens
gctgtatattaaggcgccggcgatcgcggcctgaggctgctcccggacaagggcaacgagcgtttcgtttggacttctcgacttgagtgcccgcctccttcgccgccgcctctgcagtcctcagcgcagtctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagaggcggcggcgcgagcagcaataaatactacacccgcgggaaggacgaacaaaaaaccccgtccgcccccgcgccatgttatgataaagcagaaggggcgcgccacaaagagaggaggtgtggtacctatattaaatcaaacacccggagagcggccgcgacccggcgcaaaaaaaggagccgcgcgagggagagcacaacaaaacgccgagcggcccgagcacatagccagacacaagagagcaaacacaaaccacaccaccgtcgggcggcgggcagcgaacaacaaccgagggacgaacacaaccccacacaccccgcagcgggagcaaataaagaagggccccagcacgggcgggaaacaataagccaacgtcccccacgaacgcatctcacgcgggcgaccacaaaccagacgaacacaaacaccagcgccggcgccagacaacaagtcgagagcagagacgacgcaccctccaaccccacc

SEQ ID NO: 298794 - DNA, 2414 bp, Homo sapiens
gctgtatattaaggcgccggcgatcgcggcctgaggctgctcccggacaagggcaacgagcgtttcgtttggacttctcgacttgagtgcccgcctccttcgccgccgcctctgcagtcctcagcgcagttatgcccagttcttcccgctgtggggacacgaccacggaggaatccttgcttcagggactcgggaccctgctggaccccttcctcgggtttaggggatgtggggaccaggagaaagtcaggatccctaagagtcttccctgcctggatggatgagtggcttcttctccacctagattctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtgaatctt

SEQ ID NO: 298795 - DNA, 2373 bp, Homo sapiens
gctgtatattaaggcgccggcgatcgcggcctgaggctgctcccggacaagggcaacgagcgtttcgtttggacttctcgacttgagtgcccgcctccttcgccgccgcctctgcagtcctcagcgcagttatgcccagttcttcccgctgtggggacacgaccacggaggaatccttgcttcagggactcgggaccctgctggaccccttcctcgggtttaggggatgtggggaccaggagaaagtcaggatccctaagagtcttccctgcctggatggatgagtggcttcttctccacctagattctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaa

SEQ ID NO: 298796 - DNA, 2183 bp, Homo sapiens
gctgtatattaaggcgccggcgatcgcggcctgaggctgctcccggacaagggcaacgagcgtttcgtttggacttctcgacttgagtgcccgcctccttcgccgccgcctctgcagtcctcagcgcagtctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccatacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtgaatctt

SEQ ID NO: 298797 - DNA, 2133 bp, Homo sapiens
tcaaccctcttcaccctggctaagatgatgccaggctgtgagatttacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtgaatctt

SEQ ID NO: 298798 - DNA, 2337 bp, Homo sapiens
gctgtatattaaggcgccggcgatcgcggcctgaggctgctcccggacaagggcaacgagcgtttcgtttggacttctcgacttgagtgcccgcctccttcgccgccgcctctgcagtcctcagcgcagtctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaaaaaaaaaggcgcgtttacacgtctgactggaaaccttgcgtaccaactaacgcttgagacatccccttcgcagttgcgatacgataggcgaacgacgccttcaacatggacccgaagcaatgcaattgacgtaaattgtaa

SEQ ID NO: 298799 - DNA, 2184 bp, Homo sapiens
gctgtatattaaggcgccggcgatcgcggcctgaggctgctcccggacaagggcaacgagcgtttcgtttggacttctcgacttgagtgcccgcctccttcgccgccgcctctgcagtcctcagcgcagtctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtgaatctt

SEQ ID NO: 298800 - DNA, 2006 bp, Homo sapiens
gctgtatattaaggcgccggcgatcgcggcctgaggctgctcccggacaagggcaacgagcgtttcgtttggacttctcgacttgagtgcccgcctccttcgccgccgcctctgcagtcctcagcgcagttatgcccagttcttcccgctgtggggacacgaccacggaggaatccttgcttcagggactcgggaccctgctggaccccttcctcgggtttaggggatgtggggaccaggagaaagtcaggatccctaagagtcttccctgcctggatggatgagtggcttcttctccacctagattctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatgctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtgaatctt

SEQ ID NO: 298801 - DNA, 1897 bp, Homo sapiens
  misc_feature (44)..(44): n is a, c, g, or t
cccacgggccagttcaatcaaacagtgtcttgaaagggaaaggncctggcggactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtgaatctt

SEQ ID NO: 298802 - DNA, 2751 bp, Homo sapiens
gctgtatattaaggcgccggcgatcgcggcctgaggctgctcccggacaagggcaacgagcgtttcgtttggacttctcgacttgagtgcccgcctccttcgccgccgcctctgcagtcctcagcgcagtctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcggataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagaggcggcggcgcgagcagcaataaatactacacccgcgggaaggacgaacaaaaaaccccgtccgcccccgcgccatgttatgataaagcagaaggggcgcgccacaaagagaggaggtgtggtacctatattaaatcaaacacccggagagcggccgcgacccggcgcaaaaaaaggagccgcgcgagggagagcacaacaaaacgccgagcggcccgagcacatagccagacacaagagagcaaacacaaaccacaccaccgtcgggcggcgggcagcgaacaacaaccgagggacgaacacaaccccacacaccccgcagcgggagcaaataaagaagggccccagcacgggcgggaaacaataagccaacgtcccccacgaacgcatctcacgcgggcgaccacaaaccagacgaacacaaacaccagcgccggcgccagacaacaagtcgagagcagagacgacgcaccctccaaccccacc

SEQ ID NO: 298803 - DNA, 1734 bp, Homo sapiens
tggcgtcagaggtccccgcggaggcaaggtcttcgcaaggcagtctgagctgcaggaggatggcaggaaagaagccggaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtgaatctt

SEQ ID NO: 298804 - DNA, 1426 bp, Homo sapiens
tttcgagcggccgcccggttatgtcaacaattaaggccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtgaatctt

SEQ ID NO: 298805 - DNA, 2010 bp, Homo sapiens
gctgtatattaaggcgccggcgatcgcggcctgaggctgctcccggacaagggcaacgagcgtttcgtttggacttctcgacttgagtgcccgcctccttcgccgccgcctctgcagtcctcagcgcagtctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggctgtgagatttactctgattctgggaaccatgcctccatgatccaagggattcgaaacagccgagtgccaaagtacatcttccgccacaatgatgtcagccacctcagagaactgctgcaaagatctgacccctcagtccccaagattgtggcatttgaaactgtccattcaatggatggggcggtgtgcccactggaagagctgtgtgatgtggcccatgagtttggagcaatcaccttcgtggatgaggtccacgcagtggggctttatggggctcgaggcggagggattggggatcgggatggagtcatgccaaaaatggacatcatttctggaacacttggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttggtgagtacctggggagctgctggtgcctcactgaggagttgcataaagctgtctttgcagtgtttataattgaagcccttcagaggc

SEQ ID NO: 298806 - DNA, 1576 bp, Homo sapiens
gctgtatattaaggcgccggcgatcgcggcctgaggctgctcccggacaagggcaacgagcgtttcgtttggacttctcgacttgagtgcccgcctccttcgccgccgcctctgcagtcctcagcgcagtctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccacgggtgtgtggggcagttatggacactttgaaacaacatggtgctggggcaggtggtactagaaatatttctggaactagtaaattccatgtggacttagagcgggagctggcagacctccatgggaaagatgccgcactcttgttttcctcgtgctttgtggccaatgactcaaccctcttcaccctggctaagatgatgccaggtaaggaagcctggcatgagtgccttcgagtttttggggtttcttagtaataacaagaatatgggcaacaaagaagccttaccagaacctctcaattgaaaatcataatcctatctgggcattggttctggggtcaagcatgaaatgctgactgtacattatgggctccaggagaacgtgataccagtgaaaattcaaacttgaaacgtctcatccttgagctaattgcctcaaatatgttttgtattctaagatgatcctttggagaagtctcttaatcatttagttagctcttgattgagtttggagtgaggcagtcagatttaagagcagattaatggcctgccacaaggttattctacacctttgggccttctcacaagggaagcactaactagttattttgccaggaagaaactggcacacagtg

SEQ ID NO: 298807 - DNA, 1856 bp, Homo sapiens
gctgtatattaaggcgccggcgatcgcggcctgaggctgctcccggacaagggcaacgagcgtttcgtttggacttctcgacttgagtgcccgcctccttcgccgccgcctctgcagtcctcagcgcagtctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagaggcggcggcgcgagcagcaataaatactacacccgcgggaaggacgaacaaaaaaccccgtccgcccccgcgccatgttatgataaagcagaaggggcgcgccacaaagagaggaggtgtggtacctatattaaatcaaacacccggagagcggccgcgacccggcgcaaaaaaaggagccgcgcgagggagagcacaacaaaacgccgagcggcccgagcacatagccagacacaagagagcaaacacaaaccacaccaccgtcgggcggcgggcagcgaacaacaaccgagggacgaacacaaccccacacaccccgcagcgggagcaaataaagaagggccccagcacgggcgggaaacaataagccaacgtcccccacgaacgcatctcacgcgggcgaccacaaaccagacgaacacaaacaccagcgccggcgccagacaacaagtcgagagcagagacgacgcaccctccaaccccacc

SEQ ID NO: 298808 - DNA, 1249 bp, Homo sapiens
gctgtatattaaggcgccggcgatcgcggcctgaggctgctcccggacaagggcaacgagcgtttcgtttggacttctcgacttgagtgcccgcctccttcgccgccgcctctgcagtcctcagcgcagtctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaa

SEQ ID NO: 298809 - DNA, 1367 bp, Homo sapiens
ctagctacttgggaggctgaggcggaaggaatacttgagcccaggaggttgaggctgcagagagctatgatcatgccactgcactccagcctgggtgacagagcaagaccctgtctctaaaaaaaaaaggaagattagatatccttttatagtcatgcattgcttaacgatgggggatgtgttctgagaattgcatcactaggcgatttcatcattgtgcaaacaccatagagtgtacttacataaacctagattatatagcctaccgcacacctaggctttgtggtatggcgtgttgctcctaggctgcaaacctgtacaacatgttactgtattggatactgttggcaacaccatggtatttgtgtatctaaacatacctaaacatagaaaaggtacagtaaaaatacagtattataatcttatgggaccaccatcatatatgtggtcgtcattgactgagacatcattaatgtggtgcatgactactccaatcagtccaggaacaaattaaaaagataaggagaaaagtcagtgctttgaggctccacaacaccttgctgtgtccatttagagcaatttacagctgttgctgtaattaatgaagctatctcctcccaggcaaagcctttggttgtgttggagggtacatcgccagcacgagttctctgattgacaccgtacggtcctatgctgctggcttcatcttcaccacctctctgccacccatgctgctggctggagccctggagtctgtgcggatcctgaagagcgctgagggacgggtgcttcgccgccagcaccagcgcaacgtcaaactcatgagacagatgctaatggatgccggcctccctgttgtccactgccccagccacatcatccctgtgcgggttgcagatgctgctaaaaacacagaagtctgtgatgaactaatgagcagacataacatctacgtgcaagcaatcaattaccctacggtgccccggggagaagagctcctacggattgcccccacccctcaccacacaccccagatgatgaactacttccttgagaatctgctagtcacatggaagcaagtggggctggaactgaagcctcattcctcagctgagtgcaacttctgcaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaacatagtcctggaaataaattcttgcttaaatggtgaatctt

SEQ ID NO: 298810 - DNA, 1063 bp, Homo sapiens
gctgtatattaaggcgccggcgatcgcggcctgaggctgctcccggacaagggcaacgagcgtttcgtttggacttctcgacttgagtgcccgcctccttcgccgccgcctctgcagtcctcagcgcagtctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatctgtttccacttttcagtatgatcgtttctttgagaaaaaaattgatgagaaaaagaatgaccacacctatcgagtttttaaaactgtgaaccggcgagcacacatcttccccatggcagatgactattcagactccctcatcaccaaaaagcaagtgtcagtctggtgcagtaatgactacctaggaatgagtcgccacccctcaccacacaccccagatgatgaactacttccttggtgagtacctggggagctgctggtgcctcactgaggagttgcataaagctgtctttgcagtgtttataattgaagcccttcagaggc

SEQ ID NO: 298811 - DNA, 1048 bp, Homo sapiens
gctgtatattaaggcgccggcgatcgcggcctgaggctgctcccggacaagggcaacgagcgtttcgtttggacttctcgacttgagtgcccgcctccttcgccgccgcctctgcagtcctcagcgcagttatgcccagttcttcccgctgtggggacacgaccacggaggaatccttgcttcagggactcgggaccctgctggaccccttcctcgggtttaggggatgtggggaccaggagaaagtcaggatccctaagagtcttccctgcctggatggatgagtggcttcttctccacctagattctttccacaggagccagcatacttcctgaacatggagagtgttgttcgccgctgcccattcttatcccgagtcccccaggcctttctgcagaaagcaggcaaatctctgttgttctatgcccaaaactgccccaagatgatggaagttggggccaagccagcccctcgggcattgtccactgcagcagtacactaccaacagatcaaagaaacccctccggccagtgagaaagacaaaactgctaaggccaaggtccaacagactcctgatggatcccagcagagtccagatggcacacagcttccgtctggacaccccttgcctgccacaagccagggcactgcaagcaaatgccctttcctggcagcacagatgaatcagagaggcagcagtgtcttctgcaaagccagtcttgagcttcaggaggatgtgcaggaaatgaatgccgtgaggaaagaggttgctgaaacctcagcaggccccagtgtggttagtgtgaaaaccgatggaggggatcccagtggactgctgaagaacttccaggaggccactgcattttgaagtgatgagtgaaagagagaagtcctatttctcaggcttgagcaagttggtatctgctcaggcctgagcatgacctcaattatttcacttaaccccaggccattatcatatccagatggtcttcagagttgtctttatatgtgaattaagttatattaaattttaatctatagtaaaaa

SEQ ID NO: 298812 - DNA, 470 bp, Homo sapiens
aactttggttatgcttggccttttttgtgaactaggccataagccatttttgacaatatgtttggaagatattgtgaactcagaatagaaagttggtcccatttgtttcttgttacttttgttccagaggttgctgaaacctcagcaggccccagtgtggttagtgtgaaaaccgatggaggggatcccagtggactgctgaagaacttccaggacatcatgcaaaagcaaagaccagaaagagtgtctcatcttcttcaagataacttgccaaaatgtaagtctcattgttatttgcctgatgtagaaaagaatttataattcaaatgtacattagattaaatataaaattgcatggtgaggctgggcacagtagctcatacctgtaatcccagcactttgggaggctgaagcgggagaagatcacttgaggccaggagtttgaggccagccttggcaacatagcaaga

SEQ ID NO: 298813 - DNA, 757 bp, Homo sapiens
gcgtttcgtttggacttctcgacttgagtgcccgcctccttcgccgccgcctctgcagtcctcagcgcaggtgagggcccgcgcggtaggtgcggcgccggccgaggaagccccggggtgtcctgccagccgtggcaccgctgccccgggtgctgggaccccatcccccactgtcccagtcacccgccgccttgaggtcagcgtttatcctccagatcttttgcctagacggccgcctcagtttccccctttcggccccttccggctattcccggttgaacccgccgctttagaattcccttctcatacccctcccgtcattctcgagacctcgaccgcgggtcacctctgacccccactgccggaggactgccttctttctccagactcaactccctcgactttataagcccctgcgcgtccccagtgaggcccaaggcgctggccctcatacccctaccctcatttgtgcccctcctttctcagttatgcccagttcttcccgctgtggggacacgaccacggaggaatccttgcttcagggactcgggaccctgctggaccccttcctcgggtttaggggatgtggggaccaggagaaagtcaggatccctaagagtcttccctgcctggatggatgagtggcttcttctccacctagatgtaagccaagatgtcttatctgcactgtgcatctccctaagaaacctctggcctcccaaacctgttcttgacctttccctcatccttccgcccc

SEQ ID NO: 298814 - DNA, 2398 bp, Homo sapiens
gggaaagggaatgactgtagtaaatgatacatattttccttttttataatttatcactttattctttgacagtttatttgttttggagaggaagtggcctatcaattatgggttatgtgcaattggattttgaaaaataaaacaagctatttaggaattgaacatgagatatatggaaatataatttggtttttgttaatctcatcctctccaccttgtgtagataggttattgctagttatgatatttatttctaaaatatgttatttgaactgtgaaaagtggttcatatagtacactttgtggaacaattttatatcattaccccgatgaaaagttcaatctctggatatttaatgataacactcaggtaagggctacaaacgctgtaaattaagaacaagatattattaatgtaaaagcgctgggctgtttccttatcccacacaaagaatcttttaccttggtatatgtggatatggtatattaccttggtgtatgtatatgtgtgtatacgcacacactcatacaactgagaagcctatagtatatggttaatttttggagaaaagggtgttttattgtgggttacagatcataagtgagtgaatagatgtaattccttgatgcacaccaatagatgtgttcccattgacatcttagaagtattgtatgaagaggaggacctagggcttgaaatgaaatgagaatcaatcaattgcaacattacatgatggaataatgagaagagatactgaaactagaggatttttcatctatcaaagcttgataaattaggttgtgcaaaaacttggcagtggctttctagagatgaaactggagacatgttagtgctggataaatcatttaaaattaccatttaatttattttctacattgtttatctgaagactcagaaaatccacatatttgagcttaccagactcttgggtgcattgctgttctatcttctgcttcaacagttaggaaaataaagaccaatatgaatttggaatgtcagaatttctgacataacacattggcgaggagtatggaatgtaagggtcggtgaaagtttcatatcctggaacatcttgcattgccaattgaaagacataaaagtatgcagaatcaaaataatatgtgtccactttcatgtgtaagtgaaacatattctttacaccaactattgaagcagttgctcctagaaacctagtttctccagatttcccaagtggaaaatatttagtatgttttaagcttacattcaattactccagagtcttaggacccaaccatatacttccttttattttttattaaagaaaatgacttgttattttgtaacggctgagtcctgtgatcaaataaaagcatcagttcaatatatcagggaaattgcatgttacccagcaactgaaataataaaattcaagctctctttttctaaatgggccagagacctgatgagaaagtctccaggaagccaaactttaacatactttgtccatttttagttaggttcttggtgccaagttgtcatccctgatgcattagttgctttcagtgcattgaatgaattttatttttacttcctatgttgtaagaatggttttgaatagaaggtcagtgatggtacagattcgtataattttaaaacatgattagatggtagtgaagtgttatgagtgaggaggtataattgatgtcatgaggaagtgagtactgaatggttctatgatttaaggtaaagcagcagttgtagtaagtgtattttacaaatacacatgtaaatagaggtttacctggaaatatgtacgttctaaaaggtcaattttttaattttattttttgctggttatcctggccaagtgtcttcagaactcatccaagttacgagacgaaataaactaaaatcacctcattaatttttttcccttagttacaaccaaatgaatttatgtaatctctgaatgaactacatccctattccagccgctgatgaatatgttctccagcacaaggcagcattaaaaggaaatacttttcagtatttcttttcatgccaaaaaacctacagaataattttccaaacagtcctttattcgtaattataagaattaaacaatctaaaatattaaagatttaccctccagcacattcactgggtaaagaccatttaatttgccctctcagggaatttgaaataaattatttgtcctggatattctttaaaaactttttatttattcagcaaattttggcaaaaaaatttctttctttgcttaaaacattctggtactatataaggaacaacaaactaaaatgtatgtagtgttattttgtaatctcatcactatcaataaagctgcattcaataagaccttagtcaatgact

SEQ ID NO: 298815 - DNA, 409 bp, Homo sapiens
cagtctgtgctataacgtgtcacaggtgacttaataaagctaagtacagcatacagtaaagatactgtatggaaaagagggtcacctgcggggagggaaaaggcttcataaaggagatgtctctggaaagatgttcacttgtttgcttcatagacttcgaaagcaattctttctaggcagagagaaggtacaagaaaaggttctgaggcatgaaacatgcaggcaagttcatagaactccatctaatcagctccattaggctgtagtgtagattgaaatgaagcgataagagatgtggctggagaaactgaaaagggaccacagaaagaagagcattgaatgccaggctgagtttagcctatgtggcaatgtttcccaagtgtattttcaagataccccaacacacaca

SEQ ID NO: 298816 - DNA, 4454 bp, Homo sapiens
agtccagacaaccggcttccagctggggctggggaaagggggttggaggggtgcgccccccccccacgccccttaggggtgggggacgcgggctcagagttccagggacccaggaatgcccccccgccagccccctcggcaggcggggggagggctcagccgggagtttggcaaactcctccccgcgttgagtcattcgcctctgggaggtttaggaagcggctccgggtcggtggccccaggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaaaaaaaaaact

SEQ ID NO: 298817 - DNA, 4681 bp, Homo sapiens
agtccagacaaccggcttccagctggggctggggaaagggggttggaggggtgcgccccccccccacgccccttaggggtgggggacgcgggctcagagttccagggacccaggaatgcccccccgccagccccctcggcaggcggggggagggctcagccgggagtttggcaaactcctccccgcgttgagtcattcgcctctgggaggtttaggaagcggctccgggtcggtggccccaggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctggtgagttgtgcctgaggccccttttcaccttaaaattccctggtcactgacccctactctctcttctgcacctttccttaagttcctgggtgcagttctggctaattccaacagagggcgctgtcttctcacttcaacctccctgagcgttgaaaccaggaggggttaggaagaaaggatcctgatctggggcttgctgtaagaggtgatttcttgacttcttacagatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaaaaaaaaaact

SEQ ID NO: 298818 - DNA, 4303 bp, Homo sapiens
agtccagacaaccggcttccagctggggctggggaaagggggttggaggggtgcgccccccccccacgccccttaggggtgggggacgcgggctcagagttccagggacccaggaatgcccccccgccagccccctcggcaggcggggggagggctcagccgggagtttggcaaactcctccccgcgttgagtcattcgcctctgggaggtttaggaagcggctccgggtcggtggccccaggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaaaaaaaaaact

SEQ ID NO: 298819 - DNA, 3269 bp, Homo sapiens
ttctagttctgacccagcgctgcccctttgtcctccccagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaaaaaaaaaact

SEQ ID NO: 298820 - DNA, 2858 bp, Homo sapiens
ttctcaacgggtgatgcggttgggaaaatcaatgcagaggacacacattctggcgcttgggcatcagtttcctgtgtccaggttacagaggagtcctaattctattgaccccacattcactcttggcaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaaaaaaaaaact

SEQ ID NO: 298821 - DNA, 2240 bp, Homo sapiens
  misc_feature (14)..(14): n is a, c, g, or t
cgatctgactacgnggctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaaaaaaaaaact

SEQ ID NO: 298822 - DNA, 4400 bp, Homo sapiens
agtccagacaaccggcttccagctggggctggggaaagggggttggaggggtgcgccccccccccacgccccttaggggtgggggacgcgggctcagagttccagggacccaggaatgcccccccgccagccccctcggcaggcggggggagggctcagccgggagtttggcaaactcctccccgcgttgagtcattcgcctctgggaggtttaggaagcggctccgggtcggtggccccaggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaaaaaaaaaact

SEQ ID NO: 298823 - DNA, 4615 bp, Homo sapiens
  misc_feature (4420)..(4420): n is a, c, g, or t
agtccagacaaccggcttccagctggggctggggaaagggggttggaggggtgcgccccccccccacgccccttaggggtgggggacgcgggctcagagttccagggacccaggaatgcccccccgccagccccctcggcaggcggggggagggctcagccgggagtttggcaaactcctccccgcgttgagtcattcgcctctgggaggtttaggaagcggctccgggtcggtggccccaggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgaccagntggccccccaactgaaccaagcaaagaaataaaagcaacactactaacaccaccaaaatctttgtgggacggcattgccctcgaaaaaggttttaaaaacccatgtttgggggcggggcccaatggggtaagtagacagggcatagggtgcccaagaacacggggccggaaaggtgtggttctccataaaaaacg

SEQ ID NO: 298824 - DNA, 4456 bp, Homo sapiens
agtccagacaaccggcttccagctggggctggggaaagggggttggaggggtgcgccccccccccacgccccttaggggtgggggacgcgggctcagagttccagggacccaggaatgcccccccgccagccccctcggcaggcggggggagggctcagccgggagtttggcaaactcctccccgcgttgagtcattcgcctctgggaggtttaggaagcggctccgggtcggtggccccaggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacgtcagtgggggcactgggtcaggtcgacgcggccgcgaat

SEQ ID NO: 298825 - DNA, 1277 bp, Homo sapiens
agaggggtagtcctagcctgaattcagaggccacttttgcaggatgtagaggttggaggcactagagtcctccttattacttcttggaataagagctgtggagaaatggcagccatagtaccttaactctccctcttttcccctttatcagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaaaaaaaaaact

SEQ ID NO: 298826 - DNA, 4393 bp, Homo sapiens
agtccagacaaccggcttccagctggggctggggaaagggggttggaggggtgcgccccccccccacgccccttaggggtgggggacgcgggctcagagttccagggacccaggaatgcccccccgccagccccctcggcaggcggggggagggctcagccgggagtttggcaaactcctccccgcgttgagtcattcgcctctgggaggtttaggaagcggctccgggtcggtggccccaggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggaaaaagctcagctcaagcctccagccacctctgatgcctgagtcctcccaatttcagactcccattcctgaagaaccagtccccccaccctcattctactgaaaaggaggggtctgggtacttcttgaaggtgctgacggccagggagaagctcctctccccagcccagagacatacttgaagggccagagccaggggggtgaggagctggggatccctcccccccatgcactgtgaaggacccttgtttacacataccctcttcatggatgggggaactcagatccagggacagaggccccagcctccctgaagcctttgcattttggagagtttcctgaaacaacttggaaagataactaggaaatccattcacagttctttgggccagacatgccacaaggacttcctgtccagctccaacctgcaaagatctgtcctcagccttgccagagatccaaaagaagcccccagctaagaacctggaacttggggagttaagacctggcagctctggacagccccaccctggtgggccaacaaagaacactaactatgcatggtgccccaggaccagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttgcactgtttgactgtggtacgagctcgattgt

SEQ ID NO: 298827 - DNA, 555 bp, Homo sapiens
gaactggactacacctggtggccacaaagaacactatgtgccaggacagctcaggacagatgccacacaaggatagatgctggcccagggcccagagcccagctccaaggggaatcagaactcaaatggggccagatccagcctggggtctggagttgatctggaacccagactcagacattggcacctaatccaggcagatccaggactatatttgggcctgctccagacctgatcctggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaaaaaaaaaact

SEQ ID NO: 298828 - DNA, 3442 bp, Homo sapiens
agtccagacaaccggcttccagctggggctggggaaagggggttggaggggtgcgccccccccccacgccccttaggggtgggggacgcgggctcagagttccagggacccaggaatgcccccccgccagccccctcggcaggcggggggagggctcagccgggagtttggcaaactcctccccgcgttgagtcattcgcctctgggaggtttaggaagcggctccgggtcggtggccccaggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggagttggatcccgagggttccctgcaccaccagcaaaaacgggaagctccaagccgcagctctgcttcctcgggacctcagatcctgaaatgcccggaggctgagtgtttcaggctgcgctgtgagctcgggcccctgcaccaacaagagagccaaagtctgcagttgcatttccgagtctgggccaagactttcttgcagcgggagcaccagccatttagcctgcagtgtgaggctgtgtacaaagccctgaagatgccctaccgaatcctgcctcggcagctgccccaaaaagagcgtcaggtggccacagctgtgcaatggaccaaggcagaaggcagctatggcgtcccactgtggatcatcatcctagccatcctgtttggcctcctgctcctaggtctactcatctacatcctctacaagcttggattcttcaaacgctccctcccatatggcaccgccatggagtaaatggcatgccatttactccatggcgggggtgtagacgaaccggatgtcagcggcatcccctaaggc

SEQ ID NO: 298829 - DNA, 3643 bp, Homo sapiens
agtccagacaaccggcttccagctggggctggggaaagggggttggaggggtgcgccccccccccacgccccttaggggtgggggacgcgggctcagagttccagggacccaggaatgcccccccgccagccccctcggcaggcggggggagggctcagccgggagtttggcaaactcctccccgcgttgagtcattcgcctctgggaggtttaggaagcggctccgggtcggtggccccaggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccagggaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcagcaagaatctcaacaactcgcaaagcgacgtggtttcctttcggctctccgtggaggctcaggcccaggtcaccctgaacggtgtctccaagcctgaggcagtgctattcccagtaagcgactggcatccccgagaccagcctcagaaggaggaggacctgggacctgctgtccaccatgtctatgagctcatcaaccaaggccccagctccattagccagggtgtgctggaactcagctgtccccaggctctggaaggtcagcagctcctatatgtgaccagagttacgggactcaactgcaccaccaatcaccccattaacccaaagggcctggaggtgagatcctgaacactggcatggggaagaggagcagattcagaggaccaaggctgaggggttggggaaggttgctgggggcctgcaagaggcaatgaggatgtgcctatagctagggttgagggtcacaaggcccaaagttacctcaaaatcctctggaggaaaaaggactttcatccactgtgtttctttctgcctgaactatcccttctttgtttcccggcatacccctagggcccagttatgtgccacctcctctaggaagccttcttcaaaccttttcctctgggcccgaatgcctgttttatagttcatttactcattaacatctaattaaataagtgactgtactgaacactgttaggcccaggaaatattgcaccaaacagaactgacaaggtctccacgttcatggaacttacattctagtgaagggtgatagacatagaaaagaaaaagagaaggagaaaaattaacagggattgaaaggtgatgaagtgaagagttaataagctgtagggacactatttaaattggatcatagaaaaacctcttgaagacgtcacagctgaactgaggcctgaaagataaggttgaacctgtctataagactcagggatgagcattccaaaccaagggaacatccagtgcaaaaacaggaacacagacctaattatttacttaagcatctcctccagtgtgatctccaagaaccaagttttcctcatttccatattt

SEQ ID NO: 298830 - DNA, 2870 bp, Homo sapiens
agtccagacaaccggcttccagctggggctggggaaagggggttggaggggtgcgccccccccccacgccccttaggggtgggggacgcgggctcagagttccagggacccaggaatgcccccccgccagccccctcggcaggcggggggagggctcagccgggagtttggcaaactcctccccgcgttgagtcattcgcctctgggaggtttaggaagcggctccgggtcggtggccccaggacagggaagagcgggcgctatggggagccggacgccagagtcccctctccacgccgtgcagctgcgctggggcccccggcgccgacccccgctgctgccgctgctgttgctgctgctgccgccgccacccagggtcgggggcttcaacttagacgcggaggccccagcagtactctcggggcccccgggctccttcttcggattctcagtggagttttaccggccgggaacagacggggtcagtgtgctggtgggagcacccaaggctaataccagccagccaggagtgctgcagggtggtgctgtctacctctgtccttggggtgccagccccacacagtgcacccccattgaatttgacagcaaaggctctcggctcctggagtcctcactgtccagctcagagggagaggagcctgtggagtacaagtccttgcagtggttcggggcaacagttcgagcccatggctcctccatcttggcatgcgctccactgtacagctggcgcacagagaaggagccactgagcgaccccgtgggcacctgctacctctccacagataacttcacccgaattctggagtatgcaccctgccgctcagatttcagctgggcagcaggacagggttactgccaaggaggcttcagtgccgagttcaccaagactggccgtgtggttttaggtggaccaggaagctatttctggcaaggccagatcctgtctgccactcaggagcagattgcagaatcttattaccccgagtacctgatcaacctggttcaggggcagctgcagactcgccaggccagttccatctatgatgacagctacctaggatactctgtggctgttggtgaattcagtggtgatgacacagaagactttgttgctggtgtgcccaaagggaacctcacttacggctatgtcaccatccttaatggctcagacattcgatccctctacaacttctcaggggaacagatggcctcctactttggctatgcagtggccgccacagacgtcaatggggacgggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggaccaggatggctacaatgatgtggccatcggggctccctttggtggggagacccagcagggagtagtgtttgtatttcctgggggcccaggagggctgggctctaagccttcccaggttctgcagcccctgtgggcagccagccacaccccagacttctttggctctgcccttcgaggaggccgagacctggatggcaatggatatcctgatctgattgtggggtcctttggtgtggacaaggctgtggtatacaggggccgccccatcgtgtccgctagtgcctccctcaccatcttccccgccatgttcaacccagaggagcggagctgcagcttagaggggaaccctgtggcctgcatcaaccttagcttctgcctcaatgcttctggaaaacacgttgctgactccattggtttcacagtggaacttcagctggactggcagaagcagaagggaggggtacggcgggcactgttcctggcctccaggcaggcaaccctgacccagaccctgctcatccagaatggggctcgagaggattgcagagagatgaagatctacctcaggaacgagtcagaatttcgagacaaactctcgccgattcacatcgctctcaacttctccttggacccccaagccccagtggacagccacggcctcaggccagccctacattatcagagcaagagccggatagaggacaaggctcagatcttgctggactgtggagaagacaacatctgtgtgcctgacctgcagctggaagtgtttggggagcagaaccatgtgtacctgggtgacaagaatgccctgaacctcactttccatgcccagaatgtgggtgagggtggcgcctatgaggctgagcttcgggtcaccgcccctccagaggctgagtactcaggactcgtcagacacccaggggtgagatgagactctcgagtgggatttgggaggatacccctctagaggggacaccaaaacctgaccagtgcccaccccatctccagaacttctccagcctgagctgtgactactttgccgtgaaccagagccgcctgctggtgtgtgacctgggcaaccccatgaaggcaggagccagtctgtggggtggccttcggtttacagtccctcatctccgggacactaagaaaaccatccagtttgacttccagatcctcaggtagggagtgagtgtgtctaggctggggctgagctggggacggaagggagggctgggcgccattctcactggctgcactccagcacctcagtcttgcctccatcccacagcaagaatctcaacaactcgcaaagcgacgtggtttcctttcggctctccgtggaggctcaggcccaggtcaccctgaacgggtcagtgccaggcaaaatggggtct

SEQ ID NO: 298831 - DNA, 388 bp, Homo sapiens
catggggctggggtcctcctgtgctatttgtacaaataaacctgaggcaggaaaaaaaaaaaaaaaaaaactggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttccctcaccttggcaccagacacccaggacttatttaaactctgttgcaagtgcaataaatctgacccagtgcccccactgaccagaactagaaaaaaaaaact

SEQ ID NO: 298832 - DNA, 494 bp, Homo sapiens
cctctcaaggctgccctgctccccaggctcagatcttgctggactgtggagaagacaacatctgtgtgcctgacctgcagctggaagtgtttgggtaagtagggctgacggtaagctagggagctccaggtgcacctggcacctgaaaaaatcagctagggacatactagctgtgtcgccttgggaagttgctgagctgctctgagctttaactcctttgtctgtatagtgggaatagtagcatttatttctcagactttttggaaagattaaatgaaataatctacataaaaaatctagcctagtgcctgccatagagttagaactcagtaagcagtgtctattgttactttattattactctttttttttttttgagacggagtcatgcccttgtcacccaggctggagtgcagtggcgcaatctcggctcactgcaacctccgcctcccaggttcaagcgattctctgcctcagcgtcccaagtagctggg

SEQ ID NO: 298833 - DNA, 447 bp, Homo sapiens
cagaaccaagagggaagagtgggaatgggacagaaaatgcaaggagagtttctccagggctttttctctagactctcgctcatacctgcattccccttgctcagggacaaggaaagagctgagagctgatgatcagagacctcaggtcttctgacgtgatggaattcagagtgtccgggatttctagcactaggattggggtggggtggcaagacagggtatcgagatgcctgggtttgcccttcccctcaggctggatgacttgctggtgggggcacccctgctcatggatcggacccctgacgggcggcctcaggaggtgggcagggtctacgtctacctgcagcacccagccggcatagagcccacgcccacccttaccctcactggccatgatgagtttggccgatttggcagctccttgacccccctgggggacctggacca

SEQ ID NO: 298834 - DNA, 193 bp, Homo sapiens
gaagagagactctttgggatccatatactggatcttatctgggtacccggtccagcttgggtgtaaaactcatccattgccaccaatctttatgaacagcagaaggtataaagattgactggcctggggactgtcttagctcctgaagccaggggagagtaaggttctctgactgagaaactctccatgccca

SEQ ID NO: 298835 - DNA, 489 bp, Homo sapiens
gtgttatgtttagttgttatgtctcttttctctcctttaatctgaaatagtttctcatcattttttctcttacatggcactaacactcatgacagttatttgcagactaattcatgattgtctggtttttcactattagattcagcttatgcaatttttggaagagaaactacatgtgtaatatattgttcttcttagtggatcatgtcagggggtgcaaaatgtcaatttatctcattcctggtgatgttacttttgatcacttggtaaagaaagtgtttactagttcctcacctctctgtggaaagggacacagctgaagccatgccttttacatagggtgctctcttgcctacacagttgtaaccgggagtggttcaagacaagacatagactcaacagttttgatgatgaattgtggaaaagaacatagcactaaccaggaattagacaagaaacagaataacagaatttctcagaaacaaacac

SEQ ID NO: 298836 - DNA, 361 bp, Homo sapiens
gtgatctgcctgcctcagccacccaaaatgctgggattacaggtgtgagccaccacatctggccaagaataatttttttattgtggtagaaaacatttaccatcttaacatttttaagtgtacagtacagtagtagtaactacatccaccctgtggtgcaacagagctttagaactttttaaatcttacaaaactgaaacaaaactgaacttcccctttcctcctccccccatccctgtcaacctgcactgtattttctttttctgagggtttgacttttcttttaggtttttttttctttaccaaaaatacagaaggtttcacgaatttttgtgtcatccttgcacagtggccatgctaa

SEQ ID NO: 298837 - DNA, 902 bp, Homo sapiens
cgccctcgcggaggaggtggtgttccgccctcctagtcgcagcaagcgcggaactggggttgcggcgtctaagtgtttccggtggattcccagggactgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaagtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggttctcatggaaaaaaaaaaaggggggcccaaaatatcctccgaggcc

SEQ ID NO: 298838 - DNA, 1636 bp, Homo sapiens
cgccctcgcggaggaggtggtgttccgccctcctagtcgcagcaagcgcggaactggggttgcggcgtctaagtgtttccggtggattcccagggactgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaagtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggttctcatggaaaaaaaaaaaaaaaaaacaaaaaaaccttgtgcgtggcgcgcggcctgggcgcccttggaaaaaacgtttcatcaaaaccaactgcgcgtggggcgagcgggggccccaggatgggtataggggacccgtgggcaaaaagcgggttccgataggggaaacccgggcgccaaagaaaacaggggcgggggggtttctcccccacccaagattaaaaaaaaagcggccggggggcgggaaaccacgaggggcggtcctgagaaaaacactctccagagagggagggcgcctgaggggggccaacaaaaaccgggagagcttatataaacaccgaggagagcgccccaacggcaaagagccccagatactaaaatttaaccgccgggcgctgtgggggtgatcaaacacaggaagcaaccagaacaaggctgaaaactagaaaagagaaagggagaggacaaaagctaaacagagcagagctatgaaaccgaacatcaagcgacatcaaaggaagaacacgcagaggaaatggaacgacaaaaaggagaagaagagaggagacagagaaagaagaaaagaagcgaaagagacaccaagaaaaacgagaagaacgcagaaggaagaaagagagaagagagggggaagagagagaggaggaggaagacagagaggaagagagaggatacaccgaacaaggagcaaacagagagaaagggaagaacagcagagaggaagaaaaagagaacagagacacggagaggaagaaacaagca

SEQ ID NO: 298839 - DNA, 2874 bp, Homo sapiens
ggcacgaggttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgcaaaaaaaaaaaaaaaaaaaaaaaaaatcagactatgtcggaggtgtggactctgcctgcctacctggtctgggaagatgttctaccatgtgagcagggctcagggtggcggcaagggctgggtggaaaggaagagcaaggccaggcgccggcgcgagactccccttgtcgtccaataacctgccagcgcctggcctggtcgccatcccacttttctccgcagatctccctagagcacgaaatcctgctgcacccgcgctacttcggccccaacttgctcaacacggtgaagcagaagctcttcaccgaggtggaggggacctgcacagggaagtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggttctcatggaaaaaaaaaaaggggggcccaaaatatcctccgaggcc

SEQ ID NO: 298840 - DNA, 4277 bp, Homo sapiens
ggcacgaggttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgcaaaaaaaaaaaaaaaaaaaaaaaaaatcagactatgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaaagtgagtgtcgagctcaccgcaccgccagatcgttcgatgcgcacacggggcgctatacctgcaacccctccccaactcctactcgtcctgccacccactctggggacccctctcctctctcaggcagccagttgcttcctgctttgggttcccagggcgccctctgcaatgctggacaataagacttccttctctcagctgagatgggtcattcattgactcctcaaacattttaaaaacccttggtgtgtgccaggacccgtgttgggctcagaacaaggtagaatgggaacaagatagaatgaggacagcccctgtggagctcacagtgtaatcattgttcctgtgtctgctctccctctgtcattctgctggttttctcttatcccctgtgcccagggaccacacaccatgggcctctatatatcttctgaatgaatgaccagaaaaagcagatcgagagtttgggggaggaaggaagtagcctgggatttgaccatctctgggctttgcacagaggggcctctctgatattaatgagctgggacccagctcagggcagtggagtacttgggcctccagcatcagaaaaacctgcaggaacatgcagattcctgagcctccttattccctacagaatcaagactgtctggggcagacctgagaatctgcattttaagaagatgattctcaggcatcccgaagattgagatctgttgcctcaaggactccagccttcttggacatttattgtgaaattaccagaacagcatttggtcttacacatactgatctctgttctgtcttcttttggtcattaagctctctgggagcagaggtgctatctacttgtccttttgctctccccgaccctacccccaagagctcagcgacttttattgcagatgtctttagaggctcttggacacacagtgtcttcctgtttctcatcctccttgcaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggttctcatggaaaaaaaaaaaaaaaaaacaaaaaaaccttgtgcgtggcgcgcggcctgggcgcccttggaaaaaacgtttcatcaaaaccaactgcgcgtggggcgagcgggggccccaggatgggtataggggacccgtgggcaaaaagcgggttccgataggggaaacccgggcgccaaagaaaacaggggcgggggggtttctcccccacccaagattaaaaaaaaagcggccggggggcgggaaaccacgaggggcggtcctgagaaaaacactctccagagagggagggcgcctgaggggggccaacaaaaaccgggagagcttatataaacaccgaggagagcgccccaacggcaaagagccccagatactaaaatttaaccgccgggcgctgtgggggtgatcaaacacaggaagcaaccagaacaaggctgaaaactagaaaagagaaagggagaggacaaaagctaaacagagcagagctatgaaaccgaacatcaagcgacatcaaaggaagaacacgcagaggaaatggaacgacaaaaaggagaagaagagaggagacagagaaagaagaaaagaagcgaaagagacaccaagaaaaacgagaagaacgcagaaggaagaaagagagaagagagggggaagagagagaggaggaggaagacagagaggaagagagaggatacaccgaacaaggagcaaacagagagaaagggaagaacagcagagaggaagaaaaagagaacagagacacggagaggaagaaacaagca

SEQ ID NO: 298841 - DNA, 4571 bp, Homo sapiens
ggcacgaggttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgcaaaaaaaaaaaaaaaaaaaaaaaaaatcagactatgtcggaggtgtggactctgcctgcctacctggtctgggaagatgttctaccatgtgagcagggctcagggtggcggcaagggctgggtggaaaggaagagcaaggccaggcgccggcgcgagactccccttgtcgtccaataacctgccagcgcctggcctggtcgccatcccacttttctccgcagatctccctagagcacgaaatcctgctgcacccgcgctacttcggccccaacttgctcaacacggtgaagcagaagctcttcaccgaggtggaggggacctgcacagggaaagtgagtgtcgagctcaccgcaccgccagatcgttcgatgcgcacacggggcgctatacctgcaacccctccccaactcctactcgtcctgccacccactctggggacccctctcctctctcaggcagccagttgcttcctgctttgggttcccagggcgccctctgcaatgctggacaataagacttccttctctcagctgagatgggtcattcattgactcctcaaacattttaaaaacccttggtgtgtgccaggacccgtgttgggctcagaacaaggtagaatgggaacaagatagaatgaggacagcccctgtggagctcacagtgtaatcattgttcctgtgtctgctctccctctgtcattctgctggttttctcttatcccctgtgcccagggaccacacaccatgggcctctatatatcttctgaatgaatgaccagaaaaagcagatcgagagtttgggggaggaaggaagtagcctgggatttgaccatctctgggctttgcacagaggggcctctctgatattaatgagctgggacccagctcagggcagtggagtacttgggcctccagcatcagaaaaacctgcaggaacatgcagattcctgagcctccttattccctacagaatcaagactgtctggggcagacctgagaatctgcattttaagaagatgattctcaggcatcccgaagattgagatctgttgcctcaaggactccagccttcttggacatttattgtgaaattaccagaacagcatttggtcttacacatactgatctctgttctgtcttcttttggtcattaagctctctgggagcagaggtgctatctacttgtccttttgctctccccgaccctacccccaagagctcagcgacttttattgcagatgtctttagaggctcttggacacacagtgtcttcctgtttctcatcctccttgcaggtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggttctcatggaaaaaaaaaaaaaaaaaacaaaaaaaccttgtgcgtggcgcgcggcctgggcgcccttggaaaaaacgtttcatcaaaaccaactgcgcgtggggcgagcgggggccccaggatgggtataggggacccgtgggcaaaaagcgggttccgataggggaaacccgggcgccaaagaaaacaggggcgggggggtttctcccccacccaagattaaaaaaaaagcggccggggggcgggaaaccacgaggggcggtcctgagaaaaacactctccagagagggagggcgcctgaggggggccaacaaaaaccgggagagcttatataaacaccgaggagagcgccccaacggcaaagagccccagatactaaaatttaaccgccgggcgctgtgggggtgatcaaacacaggaagcaaccagaacaaggctgaaaactagaaaagagaaagggagaggacaaaagctaaacagagcagagctatgaaaccgaacatcaagcgacatcaaaggaagaacacgcagaggaaatggaacgacaaaaaggagaagaagagaggagacagagaaagaagaaaagaagcgaaagagacaccaagaaaaacgagaagaacgcagaaggaagaaagagagaagagagggggaagagagagaggaggaggaagacagagaggaagagagaggatacaccgaacaaggagcaaacagagagaaagggaagaacagcagagaggaagaaaaagagaacagagacacggagaggaagaaacaagca

SEQ ID NO: 298842 - DNA, 3809 bp, Homo sapiens
ggcacgaggttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgcaaaaaaaaaaaaaaaaaaaaaaaaaatcagactatgtcggaggtgtggactctgcctgcctacctggtctgggaagatgttctaccatgtgagcagggctcagggtggcggcaagggctgggtggaaaggaagagcaaggccaggcgccggcgcgagactccccttgtcgtccaataacctgccagcgcctggcctggtcgccatcccacttttctccgcagatctccctagagcacgaaatcctgctgcacccgcgctacttcggccccaacttgctcaacacggtgaagcagaagctcttcaccgaggtggaggggacctgcacagggaaaatcaagactgtctggggcagacctgagaatctgcattttaagaagatgattctcaggcatcccgaagattgagatctgttgcctcaaggactccagccttcttggacatttattgtgaaattaccagaacagcatttggtcttacacatactgatctctgttctgtcttcttttggtcattaagctctctgggagcagaggtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggttctcatggaaaaaaaaaaaaaaaaaacaaaaaaaccttgtgcgtggcgcgcggcctgggcgcccttggaaaaaacgtttcatcaaaaccaactgcgcgtggggcgagcgggggccccaggatgggtataggggacccgtgggcaaaaagcgggttccgataggggaaacccgggcgccaaagaaaacaggggcgggggggtttctcccccacccaagattaaaaaaaaagcggccggggggcgggaaaccacgaggggcggtcctgagaaaaacactctccagagagggagggcgcctgaggggggccaacaaaaaccgggagagcttatataaacaccgaggagagcgccccaacggcaaagagccccagatactaaaatttaaccgccgggcgctgtgggggtgatcaaacacaggaagcaaccagaacaaggctgaaaactagaaaagagaaagggagaggacaaaagctaaacagagcagagctatgaaaccgaacatcaagcgacatcaaaggaagaacacgcagaggaaatggaacgacaaaaaggagaagaagagaggagacagagaaagaagaaaagaagcgaaagagacaccaagaaaaacgagaagaacgcagaaggaagaaagagagaagagagggggaagagagagaggaggaggaagacagagaggaagagagaggatacaccgaacaaggagcaaacagagagaaagggaagaacagcagagaggaagaaaaagagaacagagacacggagaggaagaaacaagca

SEQ ID NO: 298843 - DNA, 3755 bp, Homo sapiens
ggcacgaggttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgcaaaaaaaaaaaaaaaaaaaaaaaaaatcagactatgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaaagtgagtgtcgagctcaccgcaccgccagatcgttcgatgcgcacacggggcgctatacctgcaacccctccccaactcctactcgtcctgccacccactctggggacccctctcctctctcaggcagccagttgcttcctgctttgggttcccagggcgccctctgcaatgctggacaataagacttccttctctcagctgagatgggtcattcattgactcctcaaacattttaaaaacccttggtgtgtgccaggacccgtgttgggctcagaacaaggtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggttctcatggaaaaaaaaaaaaaaaaaacaaaaaaaccttgtgcgtggcgcgcggcctgggcgcccttggaaaaaacgtttcatcaaaaccaactgcgcgtggggcgagcgggggccccaggatgggtataggggacccgtgggcaaaaagcgggttccgataggggaaacccgggcgccaaagaaaacaggggcgggggggtttctcccccacccaagattaaaaaaaaagcggccggggggcgggaaaccacgaggggcggtcctgagaaaaacactctccagagagggagggcgcctgaggggggccaacaaaaaccgggagagcttatataaacaccgaggagagcgccccaacggcaaagagccccagatactaaaatttaaccgccgggcgctgtgggggtgatcaaacacaggaagcaaccagaacaaggctgaaaactagaaaagagaaagggagaggacaaaagctaaacagagcagagctatgaaaccgaacatcaagcgacatcaaaggaagaacacgcagaggaaatggaacgacaaaaaggagaagaagagaggagacagagaaagaagaaaagaagcgaaagagacaccaagaaaaacgagaagaacgcagaaggaagaaagagagaagagagggggaagagagagaggaggaggaagacagagaggaagagagaggatacaccgaacaaggagcaaacagagagaaagggaagaacagcagagaggaagaaaaagagaacagagacacggagaggaagaaacaagca

SEQ ID NO: 298844 - DNA, 3747 bp, Homo sapiens
ggcacgaggttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgcaaaaaaaaaaaaaaaaaaaaaaaaaatcagactatgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaactcaggcatcccgaagattgagatctgttgcctcaaggactccagccttcttggacatttattgtgaaattaccagaacagcatttggtcttacacatactgatctctgttctgtcttcttttggtcattaagctctctgggagcagaggtgctatctacttgtccttttgctctccccgaccctacccccaagagctcagcgacttttattgcagatgtctttagaggctcttggacacacagtgtcttcctgtttctcatcctccttgcaggtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggttctcatggaaaaaaaaaaaaaaaaaacaaaaaaaccttgtgcgtggcgcgcggcctgggcgcccttggaaaaaacgtttcatcaaaaccaactgcgcgtggggcgagcgggggccccaggatgggtataggggacccgtgggcaaaaagcgggttccgataggggaaacccgggcgccaaagaaaacaggggcgggggggtttctcccccacccaagattaaaaaaaaagcggccggggggcgggaaaccacgaggggcggtcctgagaaaaacactctccagagagggagggcgcctgaggggggccaacaaaaaccgggagagcttatataaacaccgaggagagcgccccaacggcaaagagccccagatactaaaatttaaccgccgggcgctgtgggggtgatcaaacacaggaagcaaccagaacaaggctgaaaactagaaaagagaaagggagaggacaaaagctaaacagagcagagctatgaaaccgaacatcaagcgacatcaaaggaagaacacgcagaggaaatggaacgacaaaaaggagaagaagagaggagacagagaaagaagaaaagaagcgaaagagacaccaagaaaaacgagaagaacgcagaaggaagaaagagagaagagagggggaagagagagaggaggaggaagacagagaggaagagagaggatacaccgaacaaggagcaaacagagagaaagggaagaacagcagagaggaagaaaaagagaacagagacacggagaggaagaaacaagca

SEQ ID NO: 298845 - DNA, 3799 bp, Homo sapiens
ggcacgaggttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgcaaaaaaaaaaaaaaaaaaaaaaaaaatcagactatgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaaaatcaagactgtctggggcagacctgagaatctgcattttaagaagatgattctcaggcatcccgaagattgagatctgttgcctcaaggactccagccttcttggacatttattgtgaaattaccagaacagcatttggtcttacacatactgatctctgttctgtcttcttttggtcattaagctctctgggagcagaggtgctatctacttgtccttttgctctccccgaccctacccccaagagctcagcgacttttattgcagatgtctttagaggctcttggacacacagtgtcttcctgtttctcatcctccttgcaggtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggttctcatggaaaaaaaaaaaaaaaaaacaaaaaaaccttgtgcgtggcgcgcggcctgggcgcccttggaaaaaacgtttcatcaaaaccaactgcgcgtggggcgagcgggggccccaggatgggtataggggacccgtgggcaaaaagcgggttccgataggggaaacccgggcgccaaagaaaacaggggcgggggggtttctcccccacccaagattaaaaaaaaagcggccggggggcgggaaaccacgaggggcggtcctgagaaaaacactctccagagagggagggcgcctgaggggggccaacaaaaaccgggagagcttatataaacaccgaggagagcgccccaacggcaaagagccccagatactaaaatttaaccgccgggcgctgtgggggtgatcaaacacaggaagcaaccagaacaaggctgaaaactagaaaagagaaagggagaggacaaaagctaaacagagcagagctatgaaaccgaacatcaagcgacatcaaaggaagaacacgcagaggaaatggaacgacaaaaaggagaagaagagaggagacagagaaagaagaaaagaagcgaaagagacaccaagaaaaacgagaagaacgcagaaggaagaaagagagaagagagggggaagagagagaggaggaggaagacagagaggaagagagaggatacaccgaacaaggagcaaacagagagaaagggaagaacagcagagaggaagaaaaagagaacagagacacggagaggaagaaacaagca

SEQ ID NO: 298846 - DNA, 847 bp, Homo sapiens
cgccctcgcggaggaggtggtgttccgccctcctagtcgcagcaagcgcggaactggggttgcggcgtctaagtgtttccggtggattcccagggactgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaagtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtatcacgccactgcactccagcttgggtaacaagagcgaaactccgcctca

SEQ ID NO: 298847 - DNA, 3639 bp, Homo sapiens
ggcacgaggttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgcaaaaaaaaaaaaaaaaaaaaaaaaaatcagactatgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaaaatcaagactgtctggggcagacctgagaatctgcattttaagaagatgattctcaggcatcccgaagattgagatctgttgcctcaaggactccagccttcttggacatttattgtgaaattaccagaacagcatttggtcttacacatactgatctctgttctgtcttcttttggtcattaagctctctgggagcagaggtgctatctacttgtccttttgctctccccgaccctacccccaagagctcagcgacttttattgcagatgtctttagaggctcttggacacacagtgtcttcctgtttctcatcctccttgcaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggttctcatggaaaaaaaaaaaaaaaaaacaaaaaaaccttgtgcgtggcgcgcggcctgggcgcccttggaaaaaacgtttcatcaaaaccaactgcgcgtggggcgagcgggggccccaggatgggtataggggacccgtgggcaaaaagcgggttccgataggggaaacccgggcgccaaagaaaacaggggcgggggggtttctcccccacccaagattaaaaaaaaagcggccggggggcgggaaaccacgaggggcggtcctgagaaaaacactctccagagagggagggcgcctgaggggggccaacaaaaaccgggagagcttatataaacaccgaggagagcgccccaacggcaaagagccccagatactaaaatttaaccgccgggcgctgtgggggtgatcaaacacaggaagcaaccagaacaaggctgaaaactagaaaagagaaagggagaggacaaaagctaaacagagcagagctatgaaaccgaacatcaagcgacatcaaaggaagaacacgcagaggaaatggaacgacaaaaaggagaagaagagaggagacagagaaagaagaaaagaagcgaaagagacaccaagaaaaacgagaagaacgcagaaggaagaaagagagaagagagggggaagagagagaggaggaggaagacagagaggaagagagaggatacaccgaacaaggagcaaacagagagaaagggaagaacagcagagaggaagaaaaagagaacagagacacggagaggaagaaacaagca

SEQ ID NO: 298848 - DNA, 3675 bp, Homo sapiens
ggcacgaggttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgcaaaaaaaaaaaaaaaaaaaaaaaaaatcagactatgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaaagtgagtgtcgagctcaccgcaccgccagatcgttcgatgcgcacacggggcgctatacctgcaacccctccccaactcctactcgtcctgccacccactctggggacccctctcctctctcaggcagccagttgcttcctgctttgggttcccagggcgccctctgcaatgctggacaataagacttccttctctcagctgagatgggtcattcattgactcctcaaacattttaaaaacccttggtgtgtgccaggacccgtgttgggctcagaacaaggtagaatgggaacaagatagaatgaggacagcccctgtggagctcacagtgtaatcattgttcctgtgtctgctctccctctgtcattctgctggttttctcttatcccctgtgcccagggaccacacaccatgggcctctatatatcttctgaatgaatgaccagaaaaagcagatcgagagtttgggggaggaaggaagtagcctgggatttgaccatctctgggctttgcacagaggggcctctctgatattaatgagctgggacccagctcagggcagtggagtacttgggcctccagcatcagaaaaacctgcaggaacatgcagattcctgagcctccttattccctacagaatcaagactgtctggggcagacctgagaatctgcattttaagaagatgattctcaggcatcccgaagattgagatctgttgcctcaaggactccagccttcttggacatttattgtgaaattaccagaacagcatttggtcttacacatactgatctctgttctgtcttcttttggtcattaagctctctgggagcagaggtgctatctacttgtccttttgctctccccgaccctacccccaagagctcagcgacttttattgcagatgtctttagaggctcttggacacacagtgtcttcctgtttctcatcctccttgcaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctagttttaaagtctctggctttcacaaaaaaaaaaggggggggctaaaatatcccgaggggccagtttgccgtccctttgtaaagggcccaagggaggttaaaaaagcaggcggggtaacagcgggggaacgcgctggtcttgagaacccttggcgggtgccacccacaaagtgggaaaattttgagcccgcgatggtt

SEQ ID NO: 298849 - DNA, 342 bp, Homo sapiens
atccatttaaagtgctaacctagatctcactttcctttcagtccatcccttcagagatggagtttgatcctaactccaacccaccatgttacaagacaatggatgaggtgagtggacagaaagaagtcagggagacaaggagagaatcagccatcctgagggagaatattggcctggggatggctgagtacagatggtccccgaattaccatggcttgattcatgattttatgactttacgatggtgtgaaagtgatgtgcattcaatatgcccccgggcttacagtgaagtgattgtgatgtaacttctcataaactgaggagcatctgtacactgttccc

SEQ ID NO: 298850 - DNA, 402 bp, Homo sapiens
ccatatgagatgtgaaatagagaagtggaattgtagggacggggagaaattgccagcctgggcaacagagcaagactccatctcaaaaaataaaaataaataaaaaataaaaaaataaaagagcaaactatttccaaataccatagaataacttacataaaagtaatataactgtattgtaagtagaagctagcactggttttattaatttagtgactattcattttatctaaatcagtgaagatttactgtcattgtttattagtctgtatatattaaaatatgatatcattaatgtacttacaaaatagtatgtcactgtttttatgttcattcttaaaaacataacctgtattaataaatgtgaacatttgcttggtatctctttggaacaaattagta

SEQ ID NO: 298851 - DNA, 697 bp, Homo sapiens
  misc_feature (36)..(36): n is a, c, g, or t
  misc_feature (46)..(46): n is a, c, g, or t
  misc_feature (140)..(140): n is a, c, g, or t
  misc_feature (189)..(189): n is a, c, g, or t
  misc_feature (205)..(205): n is a, c, g, or t
  misc_feature (231)..(231): n is a, c, g, or t
cctcctgccccgcttgggtcttcttagtttggttcntttgtccctnttgttcaacccatccatgttagctctaagaaggtttgaataagccatctaaacttattcacttcttggagctcacccaagtcctgatcttcttnttccaatcgtagctctttacagacacttgttgtttcgggctcaaagccntccacagtactttctnttgaaatggtttggttcgaccgtcanactcttcaaggtatatagacgctgcccgacgtccggcacttctgaaaaagtctggtcagctccgtcaggaactgctcgctctccaacaacaccatcgcggcgacgctggctcgactccctccgcctcgtgccgaattcggcttgtagtgagccgagatcgcgccactgtgctccagcctgggcaacagagcaagactccatctcaaaaaataaaaataaataaaaaataaaaaaataaaagagcaaactatttccaaataccatagaattaatttagtgactattcattttatctaaatcagtgaagatttactgtcattgtttattagtctgtatatattaaaatatgatatcattaatgtacttacaaaatagtatgtcactgtttttatgttcattcttaaaaacataacctgtattaataaatgtgaacatttgcttggtatctctttggaacaaattagta

SEQ ID NO: 298852 - DNA, 3910 bp, Homo sapiens
  misc_feature (3)..(3): n is a, c, g, or t
  misc_feature (5)..(5): n is a, c, g, or t
ggngnggggcgcacagagccagaggggcttgcgagcggcggctgagggaccgcggggagggggcgccgagcggctccagcgcagagactctcactgcacgccggaggccccttcctcgctccgcccgcgcgaccgcgcgccccagtcccgccccgccccgctaaccgccccagacacagcgctcgccgagggtcgcttggaccctgatcttacccgtgggcaccctgcgctctgcctgccgcgaagaccggctccccgacccgcagaagtcaggagagagggtgaagcggagcagcccgaggcggggcagcctcccggagcagcgccgcgcagagcccgggacaatggggccgcggcggctgctgctggtggccgcctgcttcagtctgtgcggcccgctgttgtctgcccgcacccgggcccgcaggccagaatcaaaagcaacaaatgccaccttagatccccggtcatttcttctcaggaaccccaatgataaatatgaaccattttgggaggatgaggagaaaaatgaaagtgggttaactgaatacagattagtctccatcaataaaagcagtcctcttcaaaaacaacttcctgcattcatctcagaagatgcctccggatatttgaccagctcctggctgacactctttgtcccatctgtgtacaccggagtgtttgtagtcagcctcccactaaacatcatggccatcgttgtgttcatcctgaaaatgaaggtcaagaagccggcggtggtgtacatgctgcacctggccacggcagatgtgctgtttgtgtctgtgctcccctttaagatcagctattacttttccggcagtgattggcagtttgggtctgaattgtgtcgcttcgtcactgcagcattttactgtaacatgtacgcctctatcttgctcatgacagtcataagcattgaccggtttctggctgtggtgtatcccatgcagtccctctcctggcgtactctgggaagggcttccttcacttgtctggccatctgggctttggccatcgcaggggtagtgcctctgctcctcaaggagcaaaccatccaggtgcccgggctcaacatcactacctgtcatgatgtgctcaatgaaaccctgctcgaaggctactatgcctactacttctcagccttctctgctgtcttcttttttgtgccgctgatcatttccacggtctgttatgtgtctatcattcgatgtcttagctcttccgcagttgccaaccgcagcaagaagtcccgggctttgttcctgtcagctgctgttttctgcatcttcatcatttgcttcggacccacaaacgtcctcctgattgcgcattactcattcctttctcacacttccaccacagaggctgcctactttgcctacctcctctgtgtctgtgtcagcagcataagctgctgcatcgaccccctaatttactattacgcttcctctgagtgccagaggtacgtctacagtatcttatgctgcaaagaaagttccgatcccagcagttataacagcagtgggcagttgatggcaagtaaaatggatacctgctctagtaacctgaataacagcatatacaaaaagctgttaacttaggaaaagggactgctgggaggttaaaaagaaaagtttataaaagtgaataacctgaggattctattagtccccacccaaactttattgattcacctcctaaaacaacagatgtacgacttgcatacctgctttttatgggagctgtcaagcatgtatttttgtcaattaccagaaagataacaggacgagatgacggtgttattccaagggaatattgccaatgctacagtaataaatgaatgtcacttctggatatagctaggtgacatatacatacttacatgtgtgtatatgtagatgtatgcacacacatatattatttgcagtgcagtatagaataggcactttaaaacactctttccccgcaccccagcaattatgaaaataatctctgattccctgatttaatatgcaaagtctaggttggtagagtttagccctgaacatttcatggtgttcatcaacagtgagagactccatagtttgggcttgtaccacttttgcaaataagtgtattttgaaattgtttgacggcaaggtttaagttattaagaggtaagacttagtactatctgtgcgtagaagttctagtgttttcaattttaaacatatccaagtttgaattcctaaaattatggaaacagatgaaaagcctctgttttgatatgggtagtattttttacattttacacactgtacacataagccaaaactgagcataagtcctctagtgaatgtaggctggctttcagagtaggctattcctgagagctgcatgtgtccgcccccgatggaggactccaggcagcagacacatgccagggccatgtcagacacagattggccagaaaccttcctgctgagcctcacagcagtgagactggggccactacatttgctccatcctcctgggattggctgtgaactgatcatgtttatgagaaactggcaaagcagaatgtgatatcctaggaggtaatgaccatgaaagacttctctacccatcttaaaaacaacgaaagaaggcatggacttctggatgcccatccactgggtgtaaacacatctagtagttgttctgaaatgtcagttctgatatggaagcacccattatgcgctgtggccactccaataggtgctgagtgtacagagtggaataagacagagacctgccctcaagagcaaagtagatcatgcatagagtgtgatgtatgtgtaataaatatgtttcacacaaacaaggcctgtcagctaaagaagtttgaacatttgggttactatttcttgtggttataacttaatgaaaacaatgcagtacaggacatatattttttaaaataagtctgatttaattgggcactatttatttacaaatgttttgctcaatagattgctcaaatcaggttttcttttaagaatcaatcatgtcagtctgcttagaaataacagaagaaaatagaattgacattgaaatctaggaaaattattctataatttccatttacttaagacttaatgagactttaaaagcattttttaacctcctaagtatcaagtatagaaaatcttcatggaattcacaaagtaatttggaaattaggttgaaacatatctcttatcttacgaaaaaatggtagcattttaaacaaaatagaaagttgcaaggcaaatgtttatttaaaagagcaggccaggcgcggtggctcacgcctgtaatcccagcactttgggaggctgaggcgggtggatcacgaggtcaggagatcgagaccatcctggctaacacggtgaaacccgtctctactaaaaatgcaaaaaaaattagccgggcgtggtggcaggcacctgtagtcccagctactcgggaggctgaggcaggagactggcgtgaacccaggaggcggaccttgtagtgagccgagatcgcgccactgtgctccagcctgggcaacagagcaagactccatctcaaaaaataaaaataaataaaaaataaaaaaataaaagagcaaactatttccaaataccatagaataacttacataaaagtaatataactgtattgtaagtagaagctagcactggttttattaatttagtgactattcattttatctaaatcagtgaagatttactgtcattgtttattagtctgtatatattaaaatatgatatcattaatgtacttacaaaatagtatgtcactgtttttatgttcattcttaaaaacataacctgtattaataaatgtgaacatttgcttggtatctctttggaacaaattagta

SEQ ID NO: 298853 - DNA, 3940 bp, Homo sapiens
  misc_feature (3)..(3): n is a, c, g, or t
  misc_feature (5)..(5): n is a, c, g, or t
ggngnggggcgcacagagccagaggggcttgcgagcggcggctgagggaccgcggggagggggcgccgagcggctccagcgcagagactctcactgcacgccggaggccccttcctcgctccgcccgcgcgaccgcgcgccccagtcccgccccgccccgctaaccgccccagacacagcgctcgccgagggtcgcttggaccctgatcttacccgtgggcaccctgcgctctgcctgccgcgaagaccggctccccgacccgcagaagtcaggagagagggtgaagcggagcagcccgaggcggggcagcctcccggagcagcgccgcgcagagcccgggacaatggggccgcggcggctgctgctggtggccgcctgcttcagtctgtgcggcccgctgttgtctgcccgcacccgggcccgcaggccagaatcaaaagcaacaaatgccaccttagatccccggtcatttcttctcaggaaccccaatgataaatatgaaccattttgggaggatgaggagaaaaatgaaagtgggttaactgaatacagattagtctccatcaataaaagcagtcctcttcaaaaacaacttcctgcattcatctcagaagatgcctccggatatttgaccagctcctggctgacactctttgtcccatctgtgtacaccggagtgtttgtagtcagcctcccactaaacatcatggccatcgttgtgttcatcctgaaaatgaaggtcaagaagccggcggtggtgtacatgctgcacctggccacggcagatgtgctgtttgtgtctgtgctcccctttaagatcagctattacttttccggcagtgattggcagtttgggtctgaattgtgtcgcttcgtcactgcagcattttactgtaacatgtacgcctctatcttgctcatgacagtcataagcattgaccggtttctggctgtggtgtatcccatgcagtccctctcctggcgtactctgggaagggcttccttcacttgtctggccatctgggctttggccatcgcaggggtagtgcctctgctcctcaaggagcaaaccatccaggtgcccgggctcaacatcactacctgtcatgatgtgctcaatgaaaccctgctcgaaggctactatgcctactacttctcagccttctctgctgtcttcttttttgtgccgctgatcatttccacggtctgttatgtgtctatcattcgatgtcttagctcttccgcagttgccaaccgcagcaagaagtcccgggctttgttcctgtcagctgctgttttctgcatcttcatcatttgcttcggacccacaaacgtcctcctgattgcgcattactcattcctttctcacacttccaccacagaggctgcctactttgcctacctcctctgtgtctgtgtcagcagcataagctgctgcatcgaccccctaatttactattacgcttcctctgagtgccagaggtacgtctacagtatcttatgctgcaaagaaagttccgatcccagcagttataacagcagtgggcagttgatggcaagtaaaatggatacctgctctagtaacctgaataacagcatatacaaaaagctgttaacttaggaaaagggactgctgggaggttaaaaagaaaagtttataaaagtgaataacctgaggattctattagtccccacccaaactttattgattcacctcctaaaacaacagatgtacgacttgcatacctgctttttatgggagctgtcaagcatgtatttttgtcaattaccagaaagataacaggacgagatgacggtgttattccaagggaatattgccaatgctacagtaataaatgaatgtcacttctggatatagctaggtgacatatacatacttacatgtgtgtatatgtagatgtatgcacacacatatattatttgcagtgcagtatagaataggcactttaaaacactctttccccgcaccccagcaattatgaaaataatctctgattccctgatttaatatgcaaagtctaggttggtagagtttagccctgaacatttcatggtgttcatcaacagtgagagactccatagtttgggcttgtaccacttttgcaaataagtgtattttgaaattgtttgacggcaaggtttaagttattaagaggtaagacttagtactatctgtgcgtagaagttctagtgttttcaattttaaacatatccaagtttgaattcctaaaattatggaaacagatgaaaagcctctgttttgatatgggtagtattttttacattttacacactgtacacataagccaaaactgagcataagtcctctagtgaatgtaggctggctttcagagtaggctattcctgagagctgcatgtgtccgcccccgatggaggactccaggcagcagacacatgccagggccatgtcagacacagattggccagaaaccttcctgctgagcctcacagcagtgagactggggccactacatttgctccatcctcctgggattggctgtgaactgatcatgtttatgagaaactggcaaagcagaatgtgatatcctaggaggtaatgaccatgaaagacttctctacccatcttaaaaacaacgaaagaaggcatggacttctggatgcccatccactgggtgtaaacacatctagtagttgttctgaaatgtcagttctgatatggaagcacccattatgcgctgtggccactccaataggtgctgagtgtacagagtggaataagacagagacctgccctcaagagcaaagtagatcatgcatagagtgtgatgtatgtgtaataaatatgtttcacacaaacaaggcctgtcagctaaagaagtttgaacatttgggttactatttcttgtggttataacttaatgaaaacaatgcagtacaggacatatattttttaaaataagtctgatttaattgggcactatttatttacaaatgttttgctcaatagattgctcaaatcaggttttcttttaagaatcaatcatgtcagtctgcttagaaataacagaagaaaatagaattgacattgaaatctaggaaaattattctataatttccatttacttaagacttaatgagactttaaaagcattttttaacctcctaagtatcaagtatagaaaatcttcatggaattcacaaagtaatttggaaattaggttgaaacatatctcttatcttacgaaaaaatggtagcattttaaacaaaatagaaagttgcaaggcaaatgtttatttaaaagagcaggccaggcgcggtggctcacgcctgtaatcccagcactttgggaggctgaggcgggtggatcacgaggtcaggagatcgagaccatcctggctaacacggtgaaacccgtctctactaaaaatgcaaaaaaaattagccgggcgtggtggcaggcacctgtagtcccagctactcgggaggctgaggcaggagactggcgtgaacccaggaggcggaccttgtagtgagccgagatcgcgccactgtgctccagcctgggcaacagagcaagactccatctcaaaaaataaaaataaataaaaaataaaaaaataaaagagcaaaaaaaaaaaaaacaaaaaaatgtgcccgggccgctcgggaccctaaaaagaggttttcatgaaaacccatctgttgtgggggccgggggccccctgaggggataatgagaaaccatggcgccgacaacgtggtccaccaagagaaagacctcgggaagcgacaaagcgcggcgcgttctccacccgaaataaaaaaaaccgcccgggcgggaacaccagaggtttctagacacaaactcaaggggagatgacaagaagcaagacacgggggcatacacagaggagcgccacgaaagccagaaatac

SEQ ID NO: 298854 - DNA, 4165 bp, Homo sapiens
  misc_feature (3)..(3): n is a, c, g, or t
  misc_feature (5)..(5): n is a, c, g, or t
ggngnggggcgcacagagccagaggggcttgcgagcggcggctgagggaccgcggggagggggcgccgagcggctccagcgcagagactctcactgcacgccggaggccccttcctcgctccgcccgcgcgaccgcgcgccccagtcccgccccgccccgctaaccgccccagacacagcgctcgccgagggtcgcttggaccctgatcttacccgtgggcaccctgcgctctgcctgccgcgaagaccggctccccgacccgcagaagtcaggagagagggtgaagcggagcagcccgaggcggggcagcctcccggagcagcgccgcgcagagcccgggacaatggggccgcggcggctgctgctggtggccgcctgcttcagtctgtgcggcccgctgttgtctgcccgcacccgggcccgcaggccagaatcaaaagcaacaaatgccaccttagatccccggtcatttcttctcaggaaccccaatgataaatatgaaccattttgggaggatgaggagaaaaatgaaagtgggttaactgaatacagattagtctccatcaataaaagcagtcctcttcaaaaacaacttcctgcattcatctcagaagatgcctccggatatttgaccagctcctggctgacactctttgtcccatctgtgtacaccggagtgtttgtagtcagcctcccactaaacatcatggccatcgttgtgttcatcctgaaaatgaaggtcaagaagccggcggtggtgtacatgctgcacctggccacggcagatgtgctgtttgtgtctgtgctcccctttaagatcagctattacttttccggcagtgattggcagtttgggtctgaattgtgtcgcttcgtcactgcagcattttactgtaacatgtacgcctctatcttgctcatgacagtcataagcattgaccggtttctggctgtggtgtatcccatgcagtccctctcctggcgtactctgggaagggcttccttcacttgtctggccatctgggctttggccatcgcaggggtagtgcctctgctcctcaaggagcaaaccatccaggtgcccgggctcaacatcactacctgtcatgatgtgctcaatgaaaccctgctcgaaggctactatgcctactacttctcagccttctctgctgtcttcttttttgtgccgctgatcatttccacggtctgttatgtgtctatcattcgatgtcttagctcttccgcagttgccaaccgcagcaagaagtcccgggctttgttcctgtcagctgctgttttctgcatcttcatcatttgcttcggacccacaaacgtcctcctgattgcgcattactcattcctttctcacacttccaccacagaggctgcctactttgcctacctcctctgtgtctgtgtcagcagcataagctgctgcatcgaccccctaatttactattacgcttcctctgagtgccagaggtacgtctacagtatcttatgctgcaaagaaagttccgatcccagcagttataacagcagtgggcagttgatggcaagtaaaatggatacctgctctagtaacctgaataacagcatatacaaaaagctgttaacttaggaaaagggactgctgggaggttaaaaagaaaagtttataaaagtgaataacctgaggattctattagtccccacccaaactttattgattcacctcctaaaacaacagatgtacgacttgcatacctgctttttatgggagctgtcaagcatgtatttttgtcaattaccagaaagataacaggacgagatgacggtgttattccaagggaatattgccaatgctacagtaataaatgaatgtcacttctggatatagctaggtgacatatacatacttacatgtgtgtatatgtagatgtatgcacacacatatattatttgcagtgcagtatagaataggcactttaaaacactctttccccgcaccccagcaattatgaaaataatctctgattccctgatttaatatgcaaagtctaggttggtagagtttagccctgaacatttcatggtgttcatcaacagtgagagactccatagtttgggcttgtaccacttttgcaaataagtgtattttgaaattgtttgacggcaaggtttaagttattaagaggtaagacttagtactatctgtgcgtagaagttctagtgttttcaattttaaacatatccaagtttgaaaggtcgtccccgctaaacaaaacgatcttatgttggaggcacaacacctcacgactggaacaacgaccctctgatttgtggatacctggcgccggtcttacgcctttaccttcttcgttcttctttcttaagggccaatcgttctttttatacgcaggcaccaatcctgttggcatttacaaccaatcctaaactctaaaacaatcggggtcccaccgctaagaagagaaaaagaccctttggtacaccgccaatctttaacaaaacggggtgttaccccggtttgccattaaatggggttgaaaaaattgggatacaccgtgcattgtgcattttcacgaatgtttatagggcataaattccctggaaacggaaccgccttttgggccaaaacttgggcttcggtccagctcaccctgactcggacggactccaggcagcagacacatgccagggccatgtcagacacagattggccagaaaccttcctgctgagcctcacagcagtgagactggggccactacatttgctccatcctcctgggattggctgtgaactgatcatgtttatgagaaactggcaaagcagaatgtgatatcctaggaggtaatgaccatgaaagacttctctacccatcttaaaaacaacgaaagaaggcatggacttctggatgcccatccactgggtgtaaacacatctagtagttgttctgaaatgtcagttctgatatggaagcacccattatgcgctgtggccactccaataggtgctgagtgtacagagtggaataagacagagacctgccctcaagagcaaagtagatcatgcatagagtgtgatgtatgtgtaataaatatgtttcacacaaacaaggcctgtcagctaaagaagtttgaacatttgggttactatttcttgtggttataacttaatgaaaacaatgcagtacaggacatatattttttaaaataagtctgatttaattgggcactatttatttacaaatgttttgctcaatagattgctcaaatcaggttttcttttaagaatcaatcatgtcagtctgcttagaaataacagaagaaaatagaattgacattgaaatctaggaaaattattctataatttccatttacttaagacttaatgagactttaaaagcattttttaacctcctaagtatcaagtatagaaaatcttcatggaattcacaaagtaatttggaaattaggttgaaacatatctcttatcttacgaaaaaatggtagcattttaaacaaaatagaaagttgcaaggcaaatgtttatttaaaagagcaggccaggcgcggtggctcacgcctgtaatcccagcactttgggaggctgaggcgggtggatcacgaggtcaggagatcgagaccatcctggctaacacggtgaaacccgtctctactaaaaatgcaaaaaaaattagccgggcgtggtggcaggcacctgtagtcccagctactcgggaggctgaggcaggagactggcgtgaacccaggaggcggaccttgtagtgagccgagatcgcgccactgtgctccagcctgggcaacagagcaagactccatctcaaaaaataaaaataaataaaaaataaaaaaataaaagagcaaactatttccaaataccatagaataacttacataaaagtaatataactgtattgtaagtagaagctagcactggttttattaatttagtgactattcattttatctaaatcagtgaagatttactgtcattgtttattagtctgtatatattaaaatatgatatcattaatgtacttacaaaatagtatgtcactgtttttatgttcattcttaaaaacataacctgtattaataaatgtgaacatttgcttggtatctctttggaacaaattagta

SEQ ID NO: 298855 - DNA, 3856 bp, Homo sapiens
  misc_feature (3)..(3): n is a, c, g, or t
  misc_feature (5)..(5): n is a, c, g, or t
ggngnggggcgcacagagccagaggggcttgcgagcggcggctgagggaccgcggggagggggcgccgagcggctccagcgcagagactctcactgcacgccggaggccccttcctcgctccgcccgcgcgaccgcgcgccccagtcccgccccgccccgctaaccgccccagacacagcgctcgccgagggtcgcttggaccctgatcttacccgtgggcaccctgcgctctgcctgccgcgaagaccggctccccgacccgcagaagtcaggagagagggtgaagcggagcagcccgaggcggggcagcctcccggagcagcgccgcgcagagcccgggacaatggggccgcggcggctgctgctggtggccgcctgcttcagtctgtgcggcccgctgttgtctgcccgcacccgggcccgcaggccagaatcaaaagcaacaaatgccaccttagatccccggtcatttcttctcaggaaccccaatgataaatatgaaccattttgggaggatgaggagaaaaatgaaagtgggttaactgaatacagattagtctccatcaataaaagcagtcctcttcaaaaacaacttcctgcattcatctcagaagatgcctccggatatttgaccagctcctggctgacactctttgtcccatctgtgtacaccggagtgtttgtagtcagcctcccactaaacatcatggccatcgttgtgttcatcctgaaaatgaaggtcaagaagccggcggtggtgtacatgctgcacctggccacggcagatgtgctgtttgtgtctgtgctcccctttaagatcagctattacttttccggcagtgattggcagtttgggtctgaattgtgtcgcttcgtcactgcagcattttactgtaacatgtacgcctctatcttgctcatgacagtcataagcattgaccggtttctggctgtggtgtatcccatgcagtccctctcctggcgtactctgggaagggcttccttcacttgtctggccatctgggctttggccatcgcaggggtagtgcctctgctcctcaaggagcaaaccatccaggtgcccgggctcaacatcactacctgtcatgatgtgctcaatgaaaccctgctcgaaggctactatgcctactacttctcagccttctctgctgtcttcttttttgtgccgctgatcatttccacggtctgttatgtgtctatcattcgatgtcttagctcttccgcagttgccaaccgcagcaagaagtcccgggctttgttcctgtcagctgctgttttctgcatcttcatcatttgcttcggacccacaaacgtcctcctgattgcgcattactcattcctttctcacacttccaccacagaggctgcctactttgcctacctcctctgtgtctgtgtcagcagcataagctgctgcatcgaccccctaatttactattacgcttcctctgagtgccagaggtacgtctacagtatcttatgctgcaaagaaagttccgatcccagcagttataacagcagtgggcagttgatggcaagtaaaatggatacctgctctagtaacctgaataacagcatatacaaaaagctgttaacttaggaaaagggactgctgggaggttaaaaagaaaagtttataaaagtgaataacctgaggattctattagtccccacccaaactttattgattcacctcctaaaacaacagatgtacgacttgcatacctgctttttatgggagctgtcaagcatgtatttttgtcaattaccagaaagataacaggacgagatgacggtgttattccaagggaatattgccaatgctacagtaataaatgaatgtcacttctggatatagctaggtgacatatacatacttacatgtgtgtatatgtagatgtatgcacacacatatattatttgcagtgcagtatagaataggcactttaaaacactctttccccgcaccccagcaattatgaaaataatctctgattccctgatttaatatgcaaagtctaggttggtagagtttagccctgaacatttcatggtgttcatcaacagtgagagactccatagtttgggcttgtaccacttttgcaaataagtgtattttgaaattgtttgacggcaaggtttaagttattaagaggtaagacttagtactatctgtgcgtagaagttctagtgttttcaattttaaacatatccaagtttgaattcctaaaattatggaaacagatgaaaagcctctgttttgatatgggtagtattttttacattttacacactgtacacataagccaaaactgagcataagtcctctagtgaatgtaggctggctttcagagtaggctattcctgagagctgcatgtgtccgcccccgatggaggactccaggcagcagacacatgccagggccatgtcagacacagattggccagaaaccttcctgctgagcctcacagcagtgagactggggccactacatttgctccatcctcctgggattggctgtgaactgatcatgtttatgagaaactggcaaagcagaatgtgatatcctaggaggtaatgaccatgaaagacttctctacccatcttacatctagtagttgttctgaaatgtcagttctgatatggaagcacccattatgcgctgtggccactccaataggtgctgagtgtacagagtggaataagacagagacctgccctcaagagcaaagtagatcatgcatagagtgtgatgtatgtgtaataaatatgtttcacacaaacaaggcctgtcagctaaagaagtttgaacatttgggttactatttcttgtggttataacttaatgaaaacaatgcagtacaggacatatattttttaaaataagtctgatttaattgggcactatttatttacaaatgttttgctcaatagattgctcaaatcaggttttcttttaagaatcaatcatgtcagtctgcttagaaataacagaagaaaatagaattgacattgaaatctaggaaaattattctataatttccatttacttaagacttaatgagactttaaaagcattttttaacctcctaagtatcaagtatagaaaatcttcatggaattcacaaagtaatttggaaattaggttgaaacatatctcttatcttacgaaaaaatggtagcattttaaacaaaatagaaagttgcaaggcaaatgtttatttaaaagagcaggccaggcgcggtggctcacgcctgtaatcccagcactttgggaggctgaggcgggtggatcacgaggtcaggagatcgagaccatcctggctaacacggtgaaacccgtctctactaaaaatgcaaaaaaaattagccgggcgtggtggcaggcacctgtagtcccagctactcgggaggctgaggcaggagactggcgtgaacccaggaggcggaccttgtagtgagccgagatcgcgccactgtgctccagcctgggcaacagagcaagactccatctcaaaaaataaaaataaataaaaaataaaaaaataaaagagcaaactatttccaaataccatagaataacttacataaaagtaatataactgtattgtaagtagaagctagcactggttttattaatttagtgactattcattttatctaaatcagtgaagatttactgtcattgtttattagtctgtatatattaaaatatgatatcattaatgtacttacaaaatagtatgtcactgtttttatgttcattcttaaaaacataacctgtattaataaatgtgaacatttgcttggtatctctttggaacaaattagta

SEQ ID NO: 298856 - DNA, 3330 bp, Homo sapiens
  misc_feature (3)..(3): n is a, c, g, or t
  misc_feature (5)..(5): n is a, c, g, or t
ggngnggggcgcacagagccagaggggcttgcgagcggcggctgagggaccgcggggagggggcgccgagcggctccagcgcagagactctcactgcacgccggaggccccttcctcgctccgcccgcgcgaccgcgcgccccagtcccgccccgccccgctaaccgccccagacacagcgctcgccgagggtcgcttggaccctgatcttacccgtgggcaccctgcgctctgcctgccgcgaagaccggctccccgacccgcagaagtcaggagagagggtgaagcggagcagcccgaggcggggcagcctcccggagcagcgccgcgcagagcccgggacaatggggccgcggcggctgctgctggtggccgcctgcttcagtctgtgcggcccgctgttgtctgcccgcacccgggcccgcaggccagaatcaaaagcaacaaatgccaccttagatccccggtcatttcttctcaggaaccccaatgataaatatgaaccattttgggaggatgaggagaaaaatgaaagtgggttaactgaatacagattagtctccatcaataaaagcagtcctcttcaaaaacaacttcctgcattcatctcagaagatgcctccggatatttgaccagctcctggctgacactctttgtcccatctgtgtacaccggagtgtttgtagtcagcctcccactaaacatcatggccatcgttgtgttcatcctgaaaatgaaggtcaagaagccggcggtggtgtacatgctgcacctggccacggcagatgtgctgtttgtgtctgtgctcccctttaagatcagctattacttttccggcagtgattggcagtttgggtctgaattgtgtcgcttcgtcactgcagcattttactgtaacatgtacgcctctatcttgctcatgacagtcataagcattgaccggtttctggctgtggtgtatcccatgcagtccctctcctggcgtactctgggaagggcttccttcacttgtctggccatctgggctttggccatcgcaggggtagtgcctctgctcctcaaggagcaaaccatccaggtgcccgggctcaacatcactacctgtcatgatgtgctcaatgaaaccctgctcgaaggctactatgcctactacttctcagccttctctgctgtcttcttttttgtgccgctgatcatttccacggtctgttatgtgtctatcattcgatgtcttagctcttccgcagttgccaaccgcagcaagaagtcccgggctttgttcctgtcagctgctgttttctgcatcttcatcatttgcttcggacccacaaacgtcctcctgattgcgcattactcattcctttctcacacttccaccacagaggctgcctactttgcctacctcctctgtgtctgtgtcagcagcataagctgctgcatcgaccccctaatttactattacgcttcctctgagtgccagaggtacgtctacagtatcttatgctgcaaagaaagttccgatcccagcagttataacagcagtgggcagttgatggcaagtaaaatggatacctgctctagtaacctgaataacagcatatacaaaaagctgttaacttaggaaaagggactgctgggaggttaaaaagaaaagtttataaaagtgaataacctgaggattctattagtccccacccaaactttattgattcacctcctaaaacaacagatgtacgacttgcatacctgctttttatgggagctgtcaagcatgtatttttgtcaattaccagaaagataacaggacgagatgacggtgttattccaagggaatattgccaatgctacagtaataaatgaatgtcacttctggatatagctaggtgacatatacatacttacatgtgtgtatatgtagatgtatgcacacacatatattatttgcagtgcagtatagaataggcactttaaaacactctttccccgcaccccagcaattatgaaaataatctctgattccctgatttaatatgcaaagtctaggttggtagagtttagccctgaacatttcatggtgttcatcaacagtgagagactccatagtttgggcttgtaccacttttgcaaataagtgtattttgaaattgtttgacggcaaggtttaagttattaagaggtaagacttagtactatctgtgcgtagaagttctagtgttttcaattttaaacatatccaagtttgaattcctaaaattatggaaacagatgaaaagcctctgttttgatatgggtagtattttttacattttacacactgtacacataagccaaaactgagcataagtcctctagtgaatgtaggctggctttcagagtaggctattcctgagagctgcatgtgtccgcccccgatggaggactccaggcagcagacacatgccagggccatgtcagacacagattggccagaaaccttcctgctgagcctcacagcagtgagactggggccactacatttgctccatcctcctgggattggctgtgaactgatcatgtttatgagaaactggcaaagcagaatgtgatatcctaggaggtaatgaccatgaaagacttctctacccatcttaaaaacaacgaaagaaggcatggacttctggatgcccatccactgggtgtaaacacatctagtagttgttctgaaatgtcagttctgatatggaagcacccattatgcgctgtggccactccaataggtgctgagtgtacagagtggaataagacagagacctgccctcaagagcaaagtagatcatgcatagagtgtgatgtatgtgtaataaatatgtttcacacaaacaaggcctgtcagctaaagaagtttgaacatttgggttactatttcttgtggttataacttaatgaaaacaatgcagtacaggacatatattttttaaaataagtctgatttaattgggcactatttatttacaaatgttttgctcaatagattgctcaaatcaggttttcttttaagaatcaatcatgtcagtctgcttagaaataacagaagaataacttacataaaagtaatataactgtattgtaagtagaagctagcactggttttattaatttagtgactattcattttatctaaatcagtgaagatttactgtcattgtttattagtctgtatatattaaaatatgatatcattaatgtacttacaaaatagtatgtcactgtttttatgttcattcttaaaaacataacctgtattaataaatgtgaacatttgcttggtatctctttggaacaaattagta

SEQ ID NO: 298857 - DNA, 674 bp, Homo sapiens
  misc_feature (3)..(3): n is a, c, g, or t
  misc_feature (5)..(5): n is a, c, g, or t
ggngnggggcgcacagagccagaggggcttgcgagcggcggctgagggaccgcggggagggggcgccgagcggctccagcgcagagactctcactgcacgccggaggccccttcctcgctccgcccgcgcgaccgcgcgccccagtcccgccccgccccgctaaccgccccagacacagcgctcgccgagggtcgcttggaccctgatcttacccgtgggcaccctgcgctctgcctgccgcgaagaccggctccccgacccgcagaagtcaggagagagggtgaagcggagcagcccgaggcggggcagcctcccggagcagcgccgcgcagagcccgggacaatggggccgcggcggctgctgctggtggccgcctgcttcagtctgtgcggcccgctgttgtctgcccgcacccgggcccgcaggccagtcacgtttaggtggggcgtgccacccccttcgcgggcccagccgatgcccctttggactcgatcttggagggtgcagcccgcctgccacggggtgttggatatggaggaggatggagcggaagccccctgggggagcctgcagtcctgcgttgcacttgtcattgtgtttctcccaggaccacccccaaaaagaaaagctctcacgttgctccaccaataaacgtttcgatctttaaaatat

SEQ ID NO: 298858 - DNA, 493 bp, Homo sapiens
caacttggcccaaagcaatagcaattataaaatgccattaattacaagaggcatccctactttagagatgttaacatgacaagaacataaaaaaaaaataaataaactttcaattgaacttttcatgttatgaaatatctttctataacatccttttaaattaacgtacaatattccatcagcagtaacgtatttaaccaagaatgttttagtagaaatttgggttgcttctaattttggatatcataaataaggctgcaataaagttcttaaacatatctctttgcacgtgtaagtattgccttaggagtcattcccagaaataaaaatgctaggtccaaagaaatgcaaatttctaaggatttggatatatgtcaagttgtaacccaggatgtttgagacaatttctactcctacctgccgtgtatgaagataagctcttccccatcctgaaacctgtatgtttgggaaaacaacaacaacaaaaaaaaca

SEQ ID NO: 298859 - DNA, 402 bp, Homo sapiens
acatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaagtaggtgactagtcactttccctgcgggctccagtactgatgattatgtgggtttagtacacgctca

SEQ ID NO: 298860 - DNA, 7352 bp, Homo sapiens
acatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccagtctaatactagtaatgagatgaagctaccgtcactgaaggatatttattataaaaaacaaagggaaaacaagcagttacctgagaggaatctcacttctgcttccaacccaaatcatccaccagaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggtacagccaacagtgtcccagaatgcatttcattgacttccttggaagatcctgtgatattgtctaagattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatcttttaggagagtatgagtcccttggaaaagaacacaggagagtaaaggatgcattaaatacaactgagaataaattgcttgatgcatatactcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgatttgatatacttttggatgatttagatactgttcctgtgtctacattacaacgtaccaatccaagaaagcaactccagtttcttcctctagatgactcggaagcgataaccatgttaatcatagctcttgccctgaaccggtgccaaatggagtgaagaaagtatctgtgagaacagcctgggagaagaataaatcagttagctatgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcaggaagccttggaagatcgtttggaaaggattaatcgagaactgggttcagttcgcatgacgctaaagaaattccatgttttgcgcacctctgcaaatctttgagatttgtagccattaaattttgagacatttttgtttgcactaatgtataattatgcagtcagaaaaggcaaactattttgtactgtttataagccttcaaacagtagttttacaatcatgctattcttacacttgctattttatacttcaaatagccacatattttcaagatatttttgttatgctcaggaatctcttgtatattttactatttaaaaagcattatttttaaatagtatctgtctccaatttatatcaagaataaggaaatataaacagaggaagcagcttgtttctaaacaaatagtgttatccttttacaattaactgcacatcaattttatagacttgttctacattgtaaatacaattcagtttttaaaaaataaagcttaatagcttccataatgatagactagtacatgctgaatacataaacaattacagtgtaccttggatttcagttgtgttgaggtttttaaaaaatgataatgcaattcctatttgaaacgtgtcttagagtgaatatcagaatagtaataatggactcttggaaagctttgaaaactacatgaatataactcattttctttaaactttattgtctgtaagagaaaaaagagagattgtaattctctaattttatcttttctaaaaaagttaaacaattggagagccctctctggaggtctctcagagtagctctctgcccattgttctgaattaacttgtgtcccaccctggacaataaatggacagataaaccctttgaaatacaagccaccaccccgtgagggattaagagggcagcctggttttcttagtgtgcatggcttcagctgtccgtcatagttgtcatctggatatgttcacccctttccactccttcaccctggccaaaaggaaaatatttccactgtaggtgctgtaagaacactagactttagatcatcacaatctactgtatttgttaatggacagggagtgtgtccggatggagcctggtgccttcccctcggccttgcagagggctccagcccactgcctctgtggtagccgctggctctcagaagtagcacgtgggcaggagtctctcctctgatccaggagcattggcaggtttgtgttgggactgctggttaagttggagctgtgtaactacttagtttttggtagccaatcagaacgcagtgccccacatattccagctcggtacatgttgataaacagactcatccaaactttcaaaatggattcgtactaaacatgctcaggttttaaattttggtttgcttttgagcttttcctctttatgtggctcttaataataagtagttagaatgaacccaagccatcccagttattccaaagcaggctctcaaatgacctttgaggcacccttcacctggctggtccccaggccaggggtccacagccctgctccctttctcagcaaggagggtggcctgtctgacagtgcagttgaacctttgctccctactctgcaacttttgaagacttcaggctaatcaaaattacttataattagaatcaagtgcctttattcttgttttttatttttattttatttatttatttttttagatggagttttgcccttgttgcccaggctggagtgcaatggcatgatctcagctcactgcaacctctgcctcccgggttcaagcgattctcctgcctcagcctgctgggtagctgggattacaggcatctgccaccacgcccggctaattttgtgtgtgtgtatatgtctatgtgtgtgtgtgtatgtatatatctttttttttttttttagtagagatggtgtttcaccatattggccaggctggtctcaaactcctgaactcatgtgatccgcctgccttggcccctcaaagtgctgggattacaggcatgagccaccacacccggcctattcttggtattctttattcttggttttctagcctttagaaaaaaaaaatctagtcttggtaaagaaaatgttcattttaatcaagctccagtacagcttgtgtcaagacctagtaagaccacctttaatgtgttcctggatatgacattaaaaactaacttgaaaattgttaggatatttccttgttccctacttttattgtaaaatctactacattcttaagaattaaaaaatgccatttcagaagagatgatagttttatcttgccaaggaattatcttcttagtagcctatattggcttattccaaaaaaggcgttaacctccatcaaaacatcttctgcgcctctctctcagcatatgctttgatatttgaagtgtgtaatagattggagctatcagtcacttatttctaaaaaatgtattcttttttcttcatagctgtgaagagggataccaaggaaagttctttctgctgtctttctctttggtaatgcttatcttatgaacactcaactgaaaaaacactccacctaaaagcaggaaagatggcaattctaaatagcagctattatccccgggtataaactatttttgttgttggcttggggctttgctgcaggtattaatagtttaaagaaaaaaaaaaaaaaaaccctaagcaaatctgccacctctgggaagtgccttttaaaatgcaaatagaaagtgaactctcccctgatgcctggatctgcccccttcctttcccttgctaagcctctgtttgcaggagctactcctgaggtatggaaatggtctttgcaactgaaggacttttccaactgaagcaacagttgtagctaaagtggccgtgctagggttgtgcagagctgggctcaggggacaagaaaggagagacttggagccagagagacctgggtcacatcctggcacaggcctgcctttctcagctataagatgaaataagaaaactcctttcattaagggagattttgtaaagtgcctggtgcttagtaagtgctcaagaaatattatatttcagattcattgagttaagtaggtttttgaggtagcatccttttttttttttttttggaaagggagtctcaagttctggtgtggcccaggctggggagtgcagtgggtgtggatactgggctcactggcaacctggtctccggggttccaagctattctcctggcctaagcctcccgtgtaggtgggattacaggtgcataccacgcctggttaatttttgtattttcggtagagacggggttctcaccatgttggccatcctggtcttgaacttctgaccccaaatgatctgcctgccttggcctcccaaagtgttgggattacaggcgtgagccactgcgcccagccttgaggtagcatactttctgaaataaaaaagtagattatgtccgaagcagttgacctaaaaactgccttggactgacatttgttaggtggtctaagatgttctcttcacgctttgcaaaaaaatgagcttttttggagtttaaattaagcatccctctggtgtgtttggttttttagccaccaaaaatttaacaaatttgataacctgtcacgtgtaagttcagaaagcactttggtcttaattggtgacttgggggttatttggtataaatataggttctttttctaaaaattattgccagtatcctccaaataattgccccttcaaatgtttcatctaaaggtgacagcttgtgggcagaaccatgcacaggaagtgcctgccagtgggtgttaggagatgtaggtggagtctgtgatagccaaccaaaagctatccccttctcgcccagaaaagccacgtgctttgctggacgctacttgaaatctgaactctgcacctacatatgtagtaaaattagagacttttgtcactttaatttttagattatctcaagttttcactagatttcaatgtgccacttgtgctatgagtctttaagaagctttaaaaaataaatgcacacctgtagccttttaccattcagacaggtagattatatttacctgtcatgagggaccatgtatggttgacagttgcaggtttgattaaatccactatattgcacaaattttgctggaaataatttcctgccctgccaagagctctatggtagtttgataataaactactaccccagtattcttaggaactgtgttactaagtcttttctgcctgatttgtactttatttccatagacccctcagatatgtgaggaatcaagccataaatgtgcatttgctggacattatgtaccatgtcatctctatgactacagatttcaaggataatttttacatctaacaatttcactgtaacagtgaccgataatgtgagaaatgtgctttttacagtgctgctggtgggtagacaagtgcttgctgcagttgtttctgaatctagccagatgctggagtcgtgaagctgtaagctccgcgggagcagggaccatctctctttcttgcactacaggcactcaataaatacttgtggctgtgaa

SEQ ID NO: 298861 - DNA, 7446 bp, Homo sapiens
  misc_feature (7357)..(7357): n is a, c, g, or t
acatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccagtctaatactagtaatgagatgaagctaccgtcactgaaggatatttattataaaaaacaaagggaaaacaagcagttacctgagaggaatctcacttctgcttccaacccaaatcatccaccagaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggtacagccaacagtgtcccagaatgcatttcattgacttccttggaagatcctgtgatattgtctaagattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatcttttaggagagtatgagtcccttggaaaagaacacaggagagtaaaggatgcattaaatacaactgagaataaattgcttgatgcatatactcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgatttgatatacttttggatgatttagatactgttcctgtgtctacattacaacgtaccaatccaagaaagcaactccagtttcttcctctagatgactcggaagcgataaccatgttaatcatagctcttgccctgaaccggtgccaaatggagtgaagaaagtatctgtgagaacagcctgggagaagaataaatcagttagctatgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcaggaagccttggaagatcgtttggaaaggattaatcgagaactgggttcagttcgcatgacgctaaagaaattccatgttttgcgcacctctgcaaatctttgagatttgtagccattaaattttgagacatttttgtttgcactaatgtataattatgcagtcagaaaaggcaaactattttgtactgtttataagccttcaaacagtagttttacaatcatgctattcttacacttgctattttatacttcaaatagccacatattttcaagatatttttgttatgctcaggaatctcttgtatattttactatttaaaaagcattatttttaaatagtatctgtctccaatttatatcaagaataaggaaatataaacagaggaagcagcttgtttctaaacaaatagtgttatccttttacaattaactgcacatcaattttatagacttgttctacattgtaaatacaattcagtttttaaaaaataaagcttaatagcttccataatgatagactagtacatgctgaatacataaacaattacagtgtaccttggatttcagttgtgttgaggtttttaaaaaatgataatgcaattcctatttgaaacgtgtcttagagtgaatatcagaatagtaataatggactcttggaaagctttgaaaactacatgaatataactcattttctttaaactttattgtctgtaagagaaaaaagagagattgtaattctctaattttatcttttctaaaaaagttaaacaattggagagccctctctggaggtctctcagagtagctctctgcccattgttctgaattaacttgtgtcccaccctggacaataaatggacagataaaccctttgaaatacaagccaccaccccgtgagggattaagagggcagcctggttttcttagtgtgcatggcttcagctgtccgtcatagttgtcatctggatatgttcacccctttccactccttcaccctggccaaaaggaaaatatttccactgtaggtgctgtaagaacactagactttagatcatcacaatctactgtatttgttaatggacagggagtgtgtccggatggagcctggtgccttcccctcggccttgcagagggctccagcccactgcctctgtggtagccgctggctctcagaagtagcacgtgggcaggagtctctcctctgatccaggagcattggcaggtttgtgttgggactgctggttaagttggagctgtgtaactacttagtttttggtagccaatcagaacgcagtgccccacatattccagctcggtacatgttgataaacagactcatccaaactttcaaaatggattcgtactaaacatgctcaggttttaaattttggtttgcttttgagcttttcctctttatgtggctcttaataataagtagttagaatgaacccaagccatcccagttattccaaagcaggctctcaaatgacctttgaggcacccttcacctggctggtccccaggccaggggtccacagccctgctccctttctcagcaaggagggtggcctgtctgacagtgcagttgaacctttgctccctactctgcaacttttgaagacttcaggctaatcaaaattacttataattagaatcaagtgcctttattcttgttttttatttttattttatttatttatttttttagatggagttttgcccttgttgcccaggctggagtgcaatggcatgatctcagctcactgcaacctctgcctcccgggttcaagcgattctcctgcctcagcctgctgggtagctgggattacaggcatctgccaccacgcccggctaattttgtgtgtgtgtatatgtctatgtgtgtgtgtgtatgtatatatctttttttttttttttagtagagatggtgtttcaccatattggccaggctggtctcaaactcctgaactcatgtgatccgcctgccttggcccctcaaagtgctgggattacaggcatgagccaccacacccggcctattcttggtattctttattcttggttttctagcctttagaaaaaaaaaatctagtcttggtaaagaaaatgttcattttaatcaagctccagtacagcttgtgtcaagacctagtaagaccacctttaatgtgttcctggatatgacattaaaaactaacttgaaaattgttaggatatttccttgttccctacttttattgtaaaatctactacattcttaagaattaaaaaatgccatttcagaagagatgatagttttatcttgccaaggaattatcttcttagtagcctatattggcttattccaaaaaaggcgttaacctccatcaaaacatcttctgcgcctctctctcagcatatgctttgatatttgaagtgtgtaatagattggagctatcagtcacttatttctaaaaaatgtattcttttttcttcatagctgtgaagagggataccaaggaaagttctttctgctgtctttctctttggtaatgcttatcttatgaacactcaactgaaaaaacactccacctaaaagcaggaaagatggcaattctaaatagcagctattatccccgggtataaactatttttgttgttggcttggggctttgctgcaggtattaatagtttaaagaaaaaaaaaaaaaaaaccctaagcaaatctgccacctctgggaagtgccttttaaaatgcaaatagaaagtgaactctcccctgatgcctggatctgcccccttcctttcccttgctaagcctctgtttgcaggagctactcctgaggtatggaaatggtctttgcaactgaaggacttttccaactgaagcaacagttgtagctaaagtggccgtgctagggttgtgcagagctgggctcaggggacaagaaaggagagacttggagccagagagacctgggtcacatcctggcacaggcctgcctttctcagctataagatgaaataagaaaactcctttcattaagggagattttgtaaagtgcctggtgcttagtaagtgctcaagaaatattatatttcagattcattgagttaagtaggtttttgaggtagcatccttttttttttttttttggaaagggagtctcaagttctggtgtggcccaggctggggagtgcagtgggtgtggatactgggctcactggcaacctggtctccggggttccaagctattctcctggcctaagcctcccgtgtaggtgggattacaggtgcataccacgcctggttaatttttgtattttcggtagagacggggttctcaccatgttggccatcctggtcttgaacttctgaccccaaatgatctgcctgccttggcctcccaaagtgttgggattacaggcgtgagccactgcgcccagccttgaggtagcatactttctgaaataaaaaagtagattatgtccgaagcagttgacctaaaaactgccttggactgacatttgttaggtggtctaagatgttctcttcacgctttgcaaaaaaatgagcttttttggagtttaaattaagcatccctctggtgtgtttggttttttagccaccaaaaatttaacaaatttgataacctgtcacgtgtaagttcagaaagcactttggtcttaattggtgacttgggggttatttggtataaatataggttctttttctaaaaattattgccagtatcctccaaataattgccccttcaaatgtttcatctaaaggtgacagcttgtgggcagaaccatgcacaggaagtgcctgccagtgggtgttaggagatgtaggtggagtctgtgatagccaaccaaaagctatccccttctcgcccagaaaagccacgtgctttgctggacgctacttgaaatctgaactctgcacctacatatgtagtaaaattagagacttttgtcactttaatttttagattatctcaagttttcactagatttcaatgtgccacttgtgctatgagtctttaagaagctttaaaaaataaatgcacacctgtagccttttaccattcagacaggtagattatatttacctgtcatgagggaccatgtatggttgacagttgcaggtttgattaaatccactatattgcacaaattttgctggaaataatttcctgccctgccaagagctctatggtagtttgataataaactactaccccagtattcttaggaactgtgttactaagtcttttctgcctgatttgtactttatttccatagacccctcagatatgtgaggaatcaagccataaatgtgcatttgctggacattatgtaccatgtcatctctatgactacagatttcaaggataatttttacatctaacaatttcactgtaacagtgaccgataatgtgagaaatgtgctttttacagtgctgctggtgggtagacaagtgcttgctgcagttgtttctgaatctagccagatgctggagtcgtgaagctgtaagctccgcgggagcagggaccatctctctttcttgcactacaggcactcaataaatacttgtggctgtgaaaaaanaaagcttcatcatttttaataaatcaggataaaaaaactcgaggggagccccgttaccaattcgcccttattaagtcggtttaaattct

SEQ ID NO: 298862 - DNA, 7377 bp, Homo sapiens
acatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccagtctaatactagtaatgagatgaagctaccgtcactgaaggatatttattataaaaaacaaagggaaaacaagcagttacctgagaggaatctcacttctgcttccaacccaaatcatccaccagaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggtacagccaacagtgtcccagaatgcatttcattgacttccttggaagatcctgtgatattgtctaagattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatcttttaggagagtatgagtcccttggaaaagaacacaggagagtaaaggatgcattaaatacaactgagaataaattgcttgatgcatatactcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgatttgatatacttttggatgatttagatactgttcctgtgtctacattacaacgtaccaatccaagaaagcaactccagtttcttcctctagatgactcggaagcgataaccatgttaatcatagctcttgccctgaaccggtgccaaatggagtgaagaaagtatctgtgagaacagcctgggagaagaataaatcagttagctatgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcaggaagccttggaagatcgtttggaaaggattaatcgagaactgggttcagttcgcatgacgctaaagaaattccatgttttgcgcacctctgcaaatctttgagatttgtagccattaaattttgagacatttttgtttgcactaatgtataattatgcagtcagaaaaggcaaactattttgtactgtttataagccttcaaacagtagttttacaatcatgctattcttacacttgctattttatacttcaaatagccacatattttcaagatatttttgttatgctcaggaatctcttgtatattttactatttaaaaagcattatttttaaatagtatctgtctccaatttatatcaagaataaggaaatataaacagaggaagcagcttgtttctaaacaaatagtgttatccttttacaattaactgcacatcaattttatagacttgttctacattgtaaatacaattcagtttttaaaaaataaagcttaatagcttccataatgatagactagtacatgctgaatacataaacaattacagtgtaccttggatttcagttgtgttgaggtttttaaaaaatgataatgcaattcctatttgaaacgtgtcttagagtgaatatcagaatagtaataatggactcttggaaagctttgaaaactacatgaatataactcattttctttaaactttattgtctgtaagagaaaaaagagagattgtaattctctaattttatcttttctaaaaaagttaaacaattggagagccctctctggaggtctctcagagtagctctctgcccattgttctgaattaacttgtgtcccaccctggacaataaatggacagataaaccctttgaaatacaagccaccaccccgtgagggattaagagggcagcctggttttcttagtgtgcatggcttcagctgtccgtcatagttgtcatctggatatgttcacccctttccactccttcaccctggccaaaaggaaaatatttccactgtaggtgctgtaagaacactagactttagatcatcacaatctactgtatttgttaatggacagggagtgtgtccggatggagcctggtgccttcccctcggccttgcagagggctccagcccactgcctctgtggtagccgctggctctcagaagtagcacgtgggcaggagtctctcctctgatccaggagcattggcaggtttgtgttgggactgctggttaagttggagctgtgtaactacttagtttttggtagccaatcagaacgcagtgccccacatattccagctcggtacatgttgataaacagactcatccaaactttcaaaatggattcgtactaaacatgctcaggttttaaattttggtttgcttttgagcttttcctctttatgtggctcttaataataagtagttagaatgaacccaagccatcccagttattccaaagcaggctctcaaatgacctttgaggcacccttcacctggctggtccccaggccaggggtccacagccctgctccctttctcagcaaggagggtggcctgtctgacagtgcagttgaacctttgctccctactctgcaacttttgaagacttcaggctaatcaaaattacttataattagaatcaagtgcctttattcttgttttttatttttattttatttatttatttttttagatggagttttgcccttgttgcccaggctggagtgcaatggcatgatctcagctcactgcaacctctgcctcccgggttcaagcgattctcctgcctcagcctgctgggtagctgggattacaggcatctgccaccacgcccggctaattttgtgtgtgtgtatatgtctatgtgtgtgtgtgtatgtatatatctttttttttttttttagtagagatggtgtttcaccatattggccaggctggtctcaaactcctgaactcatgtgatccgcctgccttggcccctcaaagtgctgggattacaggcatgagccaccacacccggcctattcttggtattctttattcttggttttctagcctttagaaaaaaaaaatctagtcttggtaaagaaaatgttcattttaatcaagctccagtacagcttgtgtcaagacctagtaagaccacctttaatgtgttcctggatatgacattaaaaactaacttgaaaattgttaggatatttccttgttccctacttttattgtaaaatctactacattcttaagaattaaaaaatgccatttcagaagagatgatagttttatcttgccaaggaattatcttcttagtagcctatattggcttattccaaaaaaggcgttaacctccatcaaaacatcttctgcgcctctctctcagcatatgctttgatatttgaagtgtgtaatagattggagctatcagtcacttatttctaaaaaatgtattcttttttcttcatagctgtgaagagggataccaaggaaagttctttctgctgtctttctctttggtaatgcttatcttatgaacactcaactgaaaaaacactccacctaaaagcaggaaagatggcaattctaaatagcagctattatccccgggtataaactatttttgttgttggcttggggctttgctgcaggtattaatagtttaaagaaaaaaaaaaaaaaaaccctaagcaaatctgccacctctgggaagtgccttttaaaatgcaaatagaaagtgaactctcccctgatgcctggatctgcccccttcctttcccttgctaagcctctgtttgcaggagctactcctgaggtatggaaatggtctttgcaactgaaggacttttccaactgaagcaacagttgtagctaaagtggccgtgctagggttgtgcagagctgggctcaggggacaagaaaggagagacttggagccagagagacctgggtcacatcctggcacaggcctgcctttctcagctataagatgaaataagaaaactcctttcattaagggagattttgtaaagtgcctggtgcttagtaagtgctcaagaaatattatatttcagattcattgagttaagtaggtttttgaggtagcatccttttttttttttttttggaaagggagtctcaagttctggtgtggcccaggctggggagtgcagtgggtgtggatactgggctcactggcaacctggtctccggggttccaagctattctcctggcctaagcctcccgtgtaggtgggattacaggtgcataccacgcctggttaatttttgtattttcggtagagacggggttctcaccatgttggccatcctggtcttgaacttctgaccccaaatgatctgcctgccttggcctcccaaagtgttgggattacaggcgtgagccactgcgcccagccttgaggtagcatactttctgaaataaaaaagtagattatgtccgaagcagttgacctaaaaactgccttggactgacatttgttaggtggtctaagatgttctcttcacgctttgcaaaaaaatgagcttttttggagtttaaattaagcatccctctggtgtgtttggttttttagccaccaaaaatttaacaaatttgataacctgtcacgtgtaagttcagaaagcactttggtcttaattggtgacttgggggttatttggtataaatataggttctttttctaaaaattattgccagtatcctccaaataattgccccttcaaatgtttcatctaaaggtgacagcttgtgggcagaaccatgcacaggaagtgcctgccagtgggtgttaggagatgtaggtggagtctgtgatagccaaccaaaagctatccccttctcgcccagaaaagccacgtgctttgctggacgctacttgaaatctgaactctgcacctacatatgtagtaaaattagagacttttgtcactttaatttttagattatctcaagttttcactagatttcaatgtgccacttgtgctatgagtctttaagaagctttaaaaaataaatgcacacctgtagccttttaccattcagacaggtagattatatttacctgtcatgagggaccatgtatggttgacagttgcaggtttgattaaatccactatattgcacaaattttgctggaaataatttcctgccctgccaagagctctatggtagtttgataataaactactaccccagtattcttaggaactgtgttactaagtcttttctgcctgatttgtactttatttccatagacccctcagatatgtgaggaatcaagccataaatgtgcatttgctggacattatgtaccatgtcatctctatgactacagatttcaaggataatttttacatctaacaatttcactgtaacagtgaccgataatgtgagaaatgtgctttttacagtgctgctggtgggtagacaagtgcttgctgcagttgtttctgaatctagccagatgctggagtcgtgaagctgtaagctccgcgggagcagggaccatctctctttcttgcactacaggcactcaataaatacttgtggctgtgaaaaaaaaccaacccagggcggccgct

SEQ ID NO: 298863 - DNA, 4073 bp, Homo sapiens
  misc_feature (4008)..(4008): n is a, c, g, or t
  misc_feature (4035)..(4035): n is a, c, g, or t
acatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccagtctaatactagtaatgagatgaagctaccgtcactgaaggatatttattataaaaaacaaagggaaaacaagcagttacctgagaggaatctcacttctgcttccaacccaaatcatccaccagaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggtacagccaacagtgtcccagaatgcatttcattgacttccttggaagatcctgtgatattgtctaagattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatcttttaggagagtatgagtcccttggaaaagaacacaggagagtaaaggatgcattaaatacaactgagaataaattgcttgatgcatatactcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgatttgatatacttttggatgatttagatactgttcctgtgtctacattacaacgtaccaatccaagaaagcaactccagtttcttcctctagatgactcggaagcgataaccatgttaatcatagctcttgccctgaaccggtgccaaatggagtgaagaaagtatctgtgagaacagcctgggagaagaataaatcagttagctatgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcaggaagccttggaagatcgtttggaaaggattaatcgagaactgggttcagttcgcatgacgctaaagaaattccatgttttgcgcacctctgcaaatctttgagatttgtagccattaaattttgagacatttttgtttgcactaatgtataattatgcagtcagaaaaggcaaactattttgtactgtttataagccttcaaacagtagttttacaatcatgctattcttacacttgctattttatacttcaaatagccacatattttcaagatatttttgttatgctcaggaatctcttgtatattttactatttaaaaagcattatttttaaatagtatctgtctccaatttatatcaagaataaggaaatataaacagaggaagcagcttgtttctaaacaaatagtgttatccttttacaattaactgcacatcaattttatagacttgttctacattgtaaatacaattcagtttttaaaaaataaagcttaatagcttccataatgatagactagtacatgctgaatacataaacaattacagtgtaccttggatttcagttgtgttgaggtttttaaaaaatgataatgcaattcctatttgaaacgtgtcttagagtgaatatcagaatagtaataatggactcttggaaagctttgaaaactacatgaatataactcattttctttaaactttattgtctgtaagagaaaaaagagagattgtaattctctaattttatcttttctaaaaaagttaaacaattggagagccctctctggaggtctctcagagtagctctctgcccattgttctgaattaacttgtgtcccaccctggacaataaatggacagataaaccctttgaaatacaagccaccaccccgtgagggattaagagggcagcctggttttcttagtgtgcatggcttcagctgtccgtcatagttgtcatctggatatgttcacccctttccactccttcaccctggccaaaaggaaaatatttccactgtaggtgctgtaagaacactagactttagatcatcacaatctactgtatttgttaatggacagggagtgtgtccggatggagcctggtgccttcccctcggccttgcagagggctccagcccactgcctctgtggtagccgctggctctcagaagtagcacgtgggcaggagtctctcctctgatccaggagcattggcagatggagttttgcccttgttgcantgagctgagatctgccactgcactccngcctgggtgacagagcaagactccctcaaaacccataa

SEQ ID NO: 298864 - DNA, 7377 bp, Homo sapiens
acatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccagtctaatactagtaatgagatgaagctaccgtcactgaaggatatttattataaaaaacaaagggaaaacaagcagttacctgagaggaatctcacttctgcttccaacccaaatcatccaccagaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggtacagccaacagtgtcccagaatgcatttcattgacttccttggaagatcctgtgatattgtctaagattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatcttttaggagagtatgagtcccttggaaaagaacacaggagagtaaaggatgcattaaatacaactgagaataaattgcttgatgcatatactcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgatttgatatacttttggatgatttagatactgttcctgtgtctacattacaacgtaccaatccaagaaagcaactccagtttcttcctctagatgactcggaagaaaaaacttattctgagaaagccaccgataaccatgttaatcatagctcttgccctgaaccggtgccaaatggagtgaagaaagtatctgtgagaacagcctgggagaagaataaatcagttagctatgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcaggaagccttggaagatcgtttggaaaggattaatcgagaactgggttcagttcgcatgacgctaaagaaattccatgttttgcgcacctctgcaaatctttgagatttgtagccattaaattttgagacatttttgtttgcactaatgtataattatgcagtcagaaaaggcaaactattttgtactgtttataagccttcaaacagtagttttacaatcatgctattcttacacttgctattttatacttcaaatagccacatattttcaagatatttttgttatgctcaggaatctcttgtatattttactatttaaaaagcattatttttaaatagtatctgtctccaatttatatcaagaataaggaaatataaacagaggaagcagcttgtttctaaacaaatagtgttatccttttacaattaactgcacatcaattttatagacttgttctacattgtaaatacaattcagtttttaaaaaataaagcttaatagcttccataatgatagactagtacatgctgaatacataaacaattacagtgtaccttggatttcagttgtgttgaggtttttaaaaaatgataatgcaattcctatttgaaacgtgtcttagagtgaatatcagaatagtaataatggactcttggaaagctttgaaaactacatgaatataactcattttctttaaactttattgtctgtaagagaaaaaagagagattgtaattctctaattttatcttttctaaaaaagttaaacaattggagagccctctctggaggtctctcagagtagctctctgcccattgttctgaattaacttgtgtcccaccctggacaataaatggacagataaaccctttgaaatacaagccaccaccccgtgagggattaagagggcagcctggttttcttagtgtgcatggcttcagctgtccgtcatagttgtcatctggatatgttcacccctttccactccttcaccctggccaaaaggaaaatatttccactgtaggtgctgtaagaacactagactttagatcatcacaatctactgtatttgttaatggacagggagtgtgtccggatggagcctggtgccttcccctcggccttgcagagggctccagcccactgcctctgtggtagccgctggctctcagaagtagcacgtgggcaggagtctctcctctgatccaggagcattggcaggtttgtgttgggactgctggttaagttggagctgtgtaactacttagtttttggtagccaatcagaacgcagtgccccacatattccagctcggtacatgttgataaacagactcatccaaactttcaaaatggattcgtactaaacatgctcaggttttaaattttggtttgcttttgagcttttcctctttatgtggctcttaataataagtagttagaatgaacccaagccatcccagttattccaaagcaggctctcaaatgacctttgaggcacccttcacctggctggtccccaggccaggggtccacagccctgctccctttctcagcaaggagggtggcctgtctgacagtgcagttgaacctttgctccctactctgcaacttttgaagacttcaggctaatcaaaattacttataattagaatcaagtgcctttattcttgttttttatttttattttatttatttatttttttagatggagttttgcccttgttgcccaggctggagtgcaatggcatgatctcagctcactgcaacctctgcctcccgggttcaagcgattctcctgcctcagcctgctgggtagctgggattacaggcatctgccaccacgcccggctaattttgtgtgtgtgtatatgtctatgtgtgtgtgtgtatgtatatatctttttttttttttttagtagagatggtgtttcaccatattggccaggctggtctcaaactcctgaactcatgtgatccgcctgccttggcccctcaaagtgctgggattacaggcatgagccaccacacccggcctattcttggtattctttattcttggttttctagcctttagaaaaaaaaaatctagtcttggtaaagaaaatgttcattttaatcaagctccagtacagcttgtgtcaagacctagtaagaccacctttaatgtgttcctggatatgacattaaaaactaacttgaaaattgttaggatatttccttgttccctacttttattgtaaaatctactacattcttaagaattaaaaaatgccatttcagaagagatgatagttttatcttgccaaggaattatcttcttagtagcctatattggcttattccaaaaaaggcgttaacctccatcaaaacatcttctgcgcctctctctcagcatatgctttgatatttgaagtgtgtaatagattggagctatcagtcacttatttctaaaaaatgtattcttttttcttcatagctgtgaagagggataccaaggaaagttctttctgctgtctttctctttggtaatgcttatcttatgaacactcaactgaaaaaacactccacctaaaagcaggaaagatggcaattctaaatagcagctattatccccgggtataaactatttttgttgttggcttggggctttgctgcaggtattaatagtttaaagaaaaaaaaaaaaaaaaccctaagcaaatctgccacctctgggaagtgccttttaaaatgcaaatagaaagtgaactctcccctgatgcctggatctgcccccttcctttcccttgctaagcctctgtttgcaggagctactcctgaggtatggaaatggtctttgcaactgaaggacttttccaactgaagcaacagttgtagctaaagtggccgtgctagggttgtgcagagctgggctcaggggacaagaaaggagagacttggagccagagagacctgggtcacatcctggcacaggcctgcctttctcagctataagatgaaataagaaaactcctttcattaagggagattttgtaaagtgcctggtgcttagtaagtgctcaagaaatattatatttcagattcattgagttaagtaggtttttgaggtagcatccttttttttttttttttggaaagggagtctcaagttctggtgtggcccaggctggggagtgcagtgggtgtggatactgggctcactggcaacctggtctccggggttccaagctattctcctggcctaagcctcccgtgtaggtgggattacaggtgcataccacgcctggttaatttttgtattttcggtagagacggggttctcaccatgttggccatcctggtcttgaacttctgaccccaaatgatctgcctgccttggcctcccaaagtgttgggattacaggcgtgagccactgcgcccagccttgaggtagcatactttctgaaataaaaaagtagattatgtccgaagcagttgacctaaaaactgccttggactgacatttgttaggtggtctaagatgttctcttcacgctttgcaaaaaaatgagcttttttggagtttaaattaagcatccctctggtgtgtttggttttttagccaccaaaaatttaacaaatttgataacctgtcacgtgtaagttcagaaagcactttggtcttaattggtgacttgggggttatttggtataaatataggttctttttctaaaaattattgccagtatcctccaaataattgccccttcaaatgtttcatctaaaggtgacagcttgtgggcagaaccatgcacaggaagtgcctgccagtgggtgttaggagatgtaggtggagtctgtgatagccaaccaaaagctatccccttctcgcccagaaaagccacgtgctttgctggacgctacttgaaatctgaactctgcacctacatatgtagtaaaattagagacttttgtcactttaatttttagattatctcaagttttcactagatttcaatgtgccacttgtgctatgagtctttaagaagctttaaaaaataaatgcacacctgtagccttttaccattcagacaggtagattatatttacctgtcatgagggaccatgtatggttgacagttgcaggtttgattaaatccactatattgcacaaattttgctggaaataatttcctgccctgccaagagctctatggtagtttgataataaactactaccccagtattcttaggaactgtgttactaagtcttttctgcctgatttgtactttatttccatagacccctcagatatgtgaggaatcaagccataaatgtgcatttgctggacattatgtaccatgtcatctctatgactacagatttcaaggataatttttacatctaacaatttcactgtaacagtgaccgataatgtgagaaatgtgctttttacagtgctgctggtgggtagacaagtgcttgctgcagttgtttctgaatctagccagatgctggagtcgtgaagctgtaagctccgcgggagcagggaccatctctctttcttgcactacaggcactcaataaatacttgtggctgtgaa

SEQ ID NO: 298865 - DNA, 7310 bp, Homo sapiens
acatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccagtctaatactagtaatgagatgaagctaccgtcactgaaggatatttattataaaaaacaaagggaaaacaagcagttacctgagaggaatctcacttctgcttccaacccaaatcatccaccagaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatcttttaggagagtatgagtcccttggaaaagaacacaggagagtaaaggatgcattaaatacaactgagaataaattgcttgatgcatatactcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgatttgatatacttttggatgatttagatactgttcctgtgtctacattacaacgtaccaatccaagaaagcaactccagtttcttcctctagatgactcggaagaaaaaacttattctgagaaagccaccgataaccatgttaatcatagctcttgccctgaaccggtgccaaatggagtgaagaaagtatctgtgagaacagcctgggagaagaataaatcagttagctatgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcaggaagccttggaagatcgtttggaaaggattaatcgagaactgggttcagttcgcatgacgctaaagaaattccatgttttgcgcacctctgcaaatctttgagatttgtagccattaaattttgagacatttttgtttgcactaatgtataattatgcagtcagaaaaggcaaactattttgtactgtttataagccttcaaacagtagttttacaatcatgctattcttacacttgctattttatacttcaaatagccacatattttcaagatatttttgttatgctcaggaatctcttgtatattttactatttaaaaagcattatttttaaatagtatctgtctccaatttatatcaagaataaggaaatataaacagaggaagcagcttgtttctaaacaaatagtgttatccttttacaattaactgcacatcaattttatagacttgttctacattgtaaatacaattcagtttttaaaaaataaagcttaatagcttccataatgatagactagtacatgctgaatacataaacaattacagtgtaccttggatttcagttgtgttgaggtttttaaaaaatgataatgcaattcctatttgaaacgtgtcttagagtgaatatcagaatagtaataatggactcttggaaagctttgaaaactacatgaatataactcattttctttaaactttattgtctgtaagagaaaaaagagagattgtaattctctaattttatcttttctaaaaaagttaaacaattggagagccctctctggaggtctctcagagtagctctctgcccattgttctgaattaacttgtgtcccaccctggacaataaatggacagataaaccctttgaaatacaagccaccaccccgtgagggattaagagggcagcctggttttcttagtgtgcatggcttcagctgtccgtcatagttgtcatctggatatgttcacccctttccactccttcaccctggccaaaaggaaaatatttccactgtaggtgctgtaagaacactagactttagatcatcacaatctactgtatttgttaatggacagggagtgtgtccggatggagcctggtgccttcccctcggccttgcagagggctccagcccactgcctctgtggtagccgctggctctcagaagtagcacgtgggcaggagtctctcctctgatccaggagcattggcaggtttgtgttgggactgctggttaagttggagctgtgtaactacttagtttttggtagccaatcagaacgcagtgccccacatattccagctcggtacatgttgataaacagactcatccaaactttcaaaatggattcgtactaaacatgctcaggttttaaattttggtttgcttttgagcttttcctctttatgtggctcttaataataagtagttagaatgaacccaagccatcccagttattccaaagcaggctctcaaatgacctttgaggcacccttcacctggctggtccccaggccaggggtccacagccctgctccctttctcagcaaggagggtggcctgtctgacagtgcagttgaacctttgctccctactctgcaacttttgaagacttcaggctaatcaaaattacttataattagaatcaagtgcctttattcttgttttttatttttattttatttatttatttttttagatggagttttgcccttgttgcccaggctggagtgcaatggcatgatctcagctcactgcaacctctgcctcccgggttcaagcgattctcctgcctcagcctgctgggtagctgggattacaggcatctgccaccacgcccggctaattttgtgtgtgtgtatatgtctatgtgtgtgtgtgtatgtatatatctttttttttttttttagtagagatggtgtttcaccatattggccaggctggtctcaaactcctgaactcatgtgatccgcctgccttggcccctcaaagtgctgggattacaggcatgagccaccacacccggcctattcttggtattctttattcttggttttctagcctttagaaaaaaaaaatctagtcttggtaaagaaaatgttcattttaatcaagctccagtacagcttgtgtcaagacctagtaagaccacctttaatgtgttcctggatatgacattaaaaactaacttgaaaattgttaggatatttccttgttccctacttttattgtaaaatctactacattcttaagaattaaaaaatgccatttcagaagagatgatagttttatcttgccaaggaattatcttcttagtagcctatattggcttattccaaaaaaggcgttaacctccatcaaaacatcttctgcgcctctctctcagcatatgctttgatatttgaagtgtgtaatagattggagctatcagtcacttatttctaaaaaatgtattcttttttcttcatagctgtgaagagggataccaaggaaagttctttctgctgtctttctctttggtaatgcttatcttatgaacactcaactgaaaaaacactccacctaaaagcaggaaagatggcaattctaaatagcagctattatccccgggtataaactatttttgttgttggcttggggctttgctgcaggtattaatagtttaaagaaaaaaaaaaaaaaaaccctaagcaaatctgccacctctgggaagtgccttttaaaatgcaaatagaaagtgaactctcccctgatgcctggatctgcccccttcctttcccttgctaagcctctgtttgcaggagctactcctgaggtatggaaatggtctttgcaactgaaggacttttccaactgaagcaacagttgtagctaaagtggccgtgctagggttgtgcagagctgggctcaggggacaagaaaggagagacttggagccagagagacctgggtcacatcctggcacaggcctgcctttctcagctataagatgaaataagaaaactcctttcattaagggagattttgtaaagtgcctggtgcttagtaagtgctcaagaaatattatatttcagattcattgagttaagtaggtttttgaggtagcatccttttttttttttttttggaaagggagtctcaagttctggtgtggcccaggctggggagtgcagtgggtgtggatactgggctcactggcaacctggtctccggggttccaagctattctcctggcctaagcctcccgtgtaggtgggattacaggtgcataccacgcctggttaatttttgtattttcggtagagacggggttctcaccatgttggccatcctggtcttgaacttctgaccccaaatgatctgcctgccttggcctcccaaagtgttgggattacaggcgtgagccactgcgcccagccttgaggtagcatactttctgaaataaaaaagtagattatgtccgaagcagttgacctaaaaactgccttggactgacatttgttaggtggtctaagatgttctcttcacgctttgcaaaaaaatgagcttttttggagtttaaattaagcatccctctggtgtgtttggttttttagccaccaaaaatttaacaaatttgataacctgtcacgtgtaagttcagaaagcactttggtcttaattggtgacttgggggttatttggtataaatataggttctttttctaaaaattattgccagtatcctccaaataattgccccttcaaatgtttcatctaaaggtgacagcttgtgggcagaaccatgcacaggaagtgcctgccagtgggtgttaggagatgtaggtggagtctgtgatagccaaccaaaagctatccccttctcgcccagaaaagccacgtgctttgctggacgctacttgaaatctgaactctgcacctacatatgtagtaaaattagagacttttgtcactttaatttttagattatctcaagttttcactagatttcaatgtgccacttgtgctatgagtctttaagaagctttaaaaaataaatgcacacctgtagccttttaccattcagacaggtagattatatttacctgtcatgagggaccatgtatggttgacagttgcaggtttgattaaatccactatattgcacaaattttgctggaaataatttcctgccctgccaagagctctatggtagtttgataataaactactaccccagtattcttaggaactgtgttactaagtcttttctgcctgatttgtactttatttccatagacccctcagatatgtgaggaatcaagccataaatgtgcatttgctggacattatgtaccatgtcatctctatgactacagatttcaaggataatttttacatctaacaatttcactgtaacagtgaccgataatgtgagaaatgtgctttttacagtgctgctggtgggtagacaagtgcttgctgcagttgtttctgaatctagccagatgctggagtcgtgaagctgtaagctccgcgggagcagggaccatctctctttcttgcactacaggcactcaataaatacttgtggctgtgaa

SEQ ID NO: 298866 - DNA, 5576 bp, Homo sapiens
aaagaccccacctccacacaccatcacattgaagattagggcttcaacatgtatgtttggtgtgggggcggggggcaagatacagacatttagtccatagcactgtatgtcttaaaattattgtttaaggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgatttgatatacttttggatgatttagatactgttcctgtgtctacattacaacgtaccaatccaagaaagcaactccagtttcttcctctagatgactcggaagaaaaaacttattctgagaaagccaccgataaccatgttaatcatagctcttgccctgaaccggtgccaaatggagtgaagaaagtatctgtgagaacagcctgggagaagaataaatcagttagctatgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcaggaagccttggaagatcgtttggaaaggattaatcgagaactgggttcagttcgcatgacgctaaagaaattccatgttttgcgcacctctgcaaatctttgagatttgtagccattaaattttgagacatttttgtttgcactaatgtataattatgcagtcagaaaaggcaaactattttgtactgtttataagccttcaaacagtagttttacaatcatgctattcttacacttgctattttatacttcaaatagccacatattttcaagatatttttgttatgctcaggaatctcttgtatattttactatttaaaaagcattatttttaaatagtatctgtctccaatttatatcaagaataaggaaatataaacagaggaagcagcttgtttctaaacaaatagtgttatccttttacaattaactgcacatcaattttatagacttgttctacattgtaaatacaattcagtttttaaaaaataaagcttaatagcttccataatgatagactagtacatgctgaatacataaacaattacagtgtaccttggatttcagttgtgttgaggtttttaaaaaatgataatgcaattcctatttgaaacgtgtcttagagtgaatatcagaatagtaataatggactcttggaaagctttgaaaactacatgaatataactcattttctttaaactttattgtctgtaagagaaaaaagagagattgtaattctctaattttatcttttctaaaaaagttaaacaattggagagccctctctggaggtctctcagagtagctctctgcccattgttctgaattaacttgtgtcccaccctggacaataaatggacagataaaccctttgaaatacaagccaccaccccgtgagggattaagagggcagcctggttttcttagtgtgcatggcttcagctgtccgtcatagttgtcatctggatatgttcacccctttccactccttcaccctggccaaaaggaaaatatttccactgtaggtgctgtaagaacactagactttagatcatcacaatctactgtatttgttaatggacagggagtgtgtccggatggagcctggtgccttcccctcggccttgcagagggctccagcccactgcctctgtggtagccgctggctctcagaagtagcacgtgggcaggagtctctcctctgatccaggagcattggcaggtttgtgttgggactgctggttaagttggagctgtgtaactacttagtttttggtagccaatcagaacgcagtgccccacatattccagctcggtacatgttgataaacagactcatccaaactttcaaaatggattcgtactaaacatgctcaggttttaaattttggtttgcttttgagcttttcctctttatgtggctcttaataataagtagttagaatgaacccaagccatcccagttattccaaagcaggctctcaaatgacctttgaggcacccttcacctggctggtccccaggccaggggtccacagccctgctccctttctcagcaaggagggtggcctgtctgacagtgcagttgaacctttgctccctactctgcaacttttgaagacttcaggctaatcaaaattacttataattagaatcaagtgcctttattcttgttttttatttttattttatttatttatttttttagatggagttttgcccttgttgcccaggctggagtgcaatggcatgatctcagctcactgcaacctctgcctcccgggttcaagcgattctcctgcctcagcctgctgggtagctgggattacaggcatctgccaccacgcccggctaattttgtgtgtgtgtatatgtctatgtgtgtgtgtgtatgtatatatctttttttttttttttagtagagatggtgtttcaccatattggccaggctggtctcaaactcctgaactcatgtgatccgcctgccttggcccctcaaagtgctgggattacaggcatgagccaccacacccggcctattcttggtattctttattcttggttttctagcctttagaaaaaaaaaatctagtcttggtaaagaaaatgttcattttaatcaagctccagtacagcttgtgtcaagacctagtaagaccacctttaatgtgttcctggatatgacattaaaaactaacttgaaaattgttaggatatttccttgttccctacttttattgtaaaatctactacattcttaagaattaaaaaatgccatttcagaagagatgatagttttatcttgccaaggaattatcttcttagtagcctatattggcttattccaaaaaaggcgttaacctccatcaaaacatcttctgcgcctctctctcagcatatgctttgatatttgaagtgtgtaatagattggagctatcagtcacttatttctaaaaaatgtattcttttttcttcatagctgtgaagagggataccaaggaaagttctttctgctgtctttctctttggtaatgcttatcttatgaacactcaactgaaaaaacactccacctaaaagcaggaaagatggcaattctaaatagcagctattatccccgggtataaactatttttgttgttggcttggggctttgctgcaggtattaatagtttaaagaaaaaaaaaaaaaaaaccctaagcaaatctgccacctctgggaagtgccttttaaaatgcaaatagaaagtgaactctcccctgatgcctggatctgcccccttcctttcccttgctaagcctctgtttgcaggagctactcctgaggtatggaaatggtctttgcaactgaaggacttttccaactgaagcaacagttgtagctaaagtggccgtgctagggttgtgcagagctgggctcaggggacaagaaaggagagacttggagccagagagacctgggtcacatcctggcacaggcctgcctttctcagctataagatgaaataagaaaactcctttcattaagggagattttgtaaagtgcctggtgcttagtaagtgctcaagaaatattatatttcagattcattgagttaagtaggtttttgaggtagcatccttttttttttttttttggaaagggagtctcaagttctggtgtggcccaggctggggagtgcagtgggtgtggatactgggctcactggcaacctggtctccggggttccaagctattctcctggcctaagcctcccgtgtaggtgggattacaggtgcataccacgcctggttaatttttgtattttcggtagagacggggttctcaccatgttggccatcctggtcttgaacttctgaccccaaatgatctgcctgccttggcctcccaaagtgttgggattacaggcgtgagccactgcgcccagccttgaggtagcatactttctgaaataaaaaagtagattatgtccgaagcagttgacctaaaaactgccttggactgacatttgttaggtggtctaagatgttctcttcacgctttgcaaaaaaatgagcttttttggagtttaaattaagcatccctctggtgtgtttggttttttagccaccaaaaatttaacaaatttgataacctgtcacgtgtaagttcagaaagcactttggtcttaattggtgacttgggggttatttggtataaatataggttctttttctaaaaattattgccagtatcctccaaataattgccccttcaaatgtttcatctaaaggtgacagcttgtgggcagaaccatgcacaggaagtgcctgccagtgggtgttaggagatgtaggtggagtctgtgatagccaaccaaaagctatccccttctcgcccagaaaagccacgtgctttgctggacgctacttgaaatctgaactctgcacctacatatgtagtaaaattagagacttttgtcactttaatttttagattatctcaagttttcactagatttcaatgtgccacttgtgctatgagtctttaagaagctttaaaaaataaatgcacacctgtagccttttaccattcagacaggtagattatatttacctgtcatgagggaccatgtatggttgacagttgcaggtttgattaaatccactatattgcacaaattttgctggaaataatttcctgccctgccaagagctctatggtagtttgataataaactactaccccagtattcttaggaactgtgttactaagtcttttctgcctgatttgtactttatttccatagacccctcagatatgtgaggaatcaagccataaatgtgcatttgctggacattatgtaccatgtcatctctatgactacagatttcaaggataatttttacatctaacaatttcactgtaacagtgaccgataatgtgagaaatgtgctttttacagtgctgctggtgggtagacaagtgcttgctgcagttgtttctgaatctagccagatgctggagtcgtgaagctgtaagctccgcgggagcagggaccatctctctttcttgcactacaggcactcaataaatacttgtggctgtgaa

SEQ ID NO: 298867 - DNA, 4968 bp, Homo sapiens
gcactgatcaaatgtgtccatttcttctggtgaaatgtgtgaagcacctcctaggctcctcttgtactgttctcacttcagcagagccaaagaattatcctcttccagttggttgtattgctattactagaatttccatatactcaatgtgtcaaacatattgagaatattttaaagtacagcagttatttggaatagttgaaaggctaattcatattgtccagtttaaaagaaatcataagatgtttcgtgtagaaagccaaataattgtaattttagtgtttatacttgctcttttgctaaaagaaaggtcagtttggtggtgattatagaacttggtatagaattctaattaaacttttcccattgttttcacctaggaagccttggaagatcgtttggaaaggattaatcgagaactgggttcagttcgcatgacgctaaagaaattccatgttttgcgcacctctgcaaatctttgagatttgtagccattaaattttgagacatttttgtttgcactaatgtataattatgcagtcagaaaaggcaaactattttgtactgtttataagccttcaaacagtagttttacaatcatgctattcttacacttgctattttatacttcaaatagccacatattttcaagatatttttgttatgctcaggaatctcttgtatattttactatttaaaaagcattatttttaaatagtatctgtctccaatttatatcaagaataaggaaatataaacagaggaagcagcttgtttctaaacaaatagtgttatccttttacaattaactgcacatcaattttatagacttgttctacattgtaaatacaattcagtttttaaaaaataaagcttaatagcttccataatgatagactagtacatgctgaatacataaacaattacagtgtaccttggatttcagttgtgttgaggtttttaaaaaatgataatgcaattcctatttgaaacgtgtcttagagtgaatatcagaatagtaataatggactcttggaaagctttgaaaactacatgaatataactcattttctttaaactttattgtctgtaagagaaaaaagagagattgtaattctctaattttatcttttctaaaaaagttaaacaattggagagccctctctggaggtctctcagagtagctctctgcccattgttctgaattaacttgtgtcccaccctggacaataaatggacagataaaccctttgaaatacaagccaccaccccgtgagggattaagagggcagcctggttttcttagtgtgcatggcttcagctgtccgtcatagttgtcatctggatatgttcacccctttccactccttcaccctggccaaaaggaaaatatttccactgtaggtgctgtaagaacactagactttagatcatcacaatctactgtatttgttaatggacagggagtgtgtccggatggagcctggtgccttcccctcggccttgcagagggctccagcccactgcctctgtggtagccgctggctctcagaagtagcacgtgggcaggagtctctcctctgatccaggagcattggcaggtttgtgttgggactgctggttaagttggagctgtgtaactacttagtttttggtagccaatcagaacgcagtgccccacatattccagctcggtacatgttgataaacagactcatccaaactttcaaaatggattcgtactaaacatgctcaggttttaaattttggtttgcttttgagcttttcctctttatgtggctcttaataataagtagttagaatgaacccaagccatcccagttattccaaagcaggctctcaaatgacctttgaggcacccttcacctggctggtccccaggccaggggtccacagccctgctccctttctcagcaaggagggtggcctgtctgacagtgcagttgaacctttgctccctactctgcaacttttgaagacttcaggctaatcaaaattacttataattagaatcaagtgcctttattcttgttttttatttttattttatttatttatttttttagatggagttttgcccttgttgcccaggctggagtgcaatggcatgatctcagctcactgcaacctctgcctcccgggttcaagcgattctcctgcctcagcctgctgggtagctgggattacaggcatctgccaccacgcccggctaattttgtgtgtgtgtatatgtctatgtgtgtgtgtgtatgtatatatctttttttttttttttagtagagatggtgtttcaccatattggccaggctggtctcaaactcctgaactcatgtgatccgcctgccttggcccctcaaagtgctgggattacaggcatgagccaccacacccggcctattcttggtattctttattcttggttttctagcctttagaaaaaaaaaatctagtcttggtaaagaaaatgttcattttaatcaagctccagtacagcttgtgtcaagacctagtaagaccacctttaatgtgttcctggatatgacattaaaaactaacttgaaaattgttaggatatttccttgttccctacttttattgtaaaatctactacattcttaagaattaaaaaatgccatttcagaagagatgatagttttatcttgccaaggaattatcttcttagtagcctatattggcttattccaaaaaaggcgttaacctccatcaaaacatcttctgcgcctctctctcagcatatgctttgatatttgaagtgtgtaatagattggagctatcagtcacttatttctaaaaaatgtattcttttttcttcatagctgtgaagagggataccaaggaaagttctttctgctgtctttctctttggtaatgcttatcttatgaacactcaactgaaaaaacactccacctaaaagcaggaaagatggcaattctaaatagcagctattatccccgggtataaactatttttgttgttggcttggggctttgctgcaggtattaatagtttaaagaaaaaaaaaaaaaaaaccctaagcaaatctgccacctctgggaagtgccttttaaaatgcaaatagaaagtgaactctcccctgatgcctggatctgcccccttcctttcccttgctaagcctctgtttgcaggagctactcctgaggtatggaaatggtctttgcaactgaaggacttttccaactgaagcaacagttgtagctaaagtggccgtgctagggttgtgcagagctgggctcaggggacaagaaaggagagacttggagccagagagacctgggtcacatcctggcacaggcctgcctttctcagctataagatgaaataagaaaactcctttcattaagggagattttgtaaagtgcctggtgcttagtaagtgctcaagaaatattatatttcagattcattgagttaagtaggtttttgaggtagcatccttttttttttttttttggaaagggagtctcaagttctggtgtggcccaggctggggagtgcagtgggtgtggatactgggctcactggcaacctggtctccggggttccaagctattctcctggcctaagcctcccgtgtaggtgggattacaggtgcataccacgcctggttaatttttgtattttcggtagagacggggttctcaccatgttggccatcctggtcttgaacttctgaccccaaatgatctgcctgccttggcctcccaaagtgttgggattacaggcgtgagccactgcgcccagccttgaggtagcatactttctgaaataaaaaagtagattatgtccgaagcagttgacctaaaaactgccttggactgacatttgttaggtggtctaagatgttctcttcacgctttgcaaaaaaatgagcttttttggagtttaaattaagcatccctctggtgtgtttggttttttagccaccaaaaatttaacaaatttgataacctgtcacgtgtaagttcagaaagcactttggtcttaattggtgacttgggggttatttggtataaatataggttctttttctaaaaattattgccagtatcctccaaataattgccccttcaaatgtttcatctaaaggtgacagcttgtgggcagaaccatgcacaggaagtgcctgccagtgggtgttaggagatgtaggtggagtctgtgatagccaaccaaaagctatccccttctcgcccagaaaagccacgtgctttgctggacgctacttgaaatctgaactctgcacctacatatgtagtaaaattagagacttttgtcactttaatttttagattatctcaagttttcactagatttcaatgtgccacttgtgctatgagtctttaagaagctttaaaaaataaatgcacacctgtagccttttaccattcagacaggtagattatatttacctgtcatgagggaccatgtatggttgacagttgcaggtttgattaaatccactatattgcacaaattttgctggaaataatttcctgccctgccaagagctctatggtagtttgataataaactactaccccagtattcttaggaactgtgttactaagtcttttctgcctgatttgtactttatttccatagacccctcagatatgtgaggaatcaagccataaatgtgcatttgctggacattatgtaccatgtcatctctatgactacagatttcaaggataatttttacatctaacaatttcactgtaacagtgaccgataatgtgagaaatgtgctttttacagtgctgctggtgggtagacaagtgcttgctgcagttgtttctgaatctagccagatgctggagtcgtgaagctgtaagctccgcgggagcagggaccatctctctttcttgcactacaggcactcaataaatacttgtggctgtgaa

SEQ ID NO: 298868 - DNA, 3645 bp, Homo sapiens
  misc_feature (2564)..(2564): n is a, c, g, or t
acatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggtacagccaacagtgtcccagaatgcatttcattgacttccttggaagatcctgtgatattgtctaagattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatcttttaggagagtatgagtcccttggaaaagaacacaggagagtaaaggatgcattaaatacaactgagaataaattgcttgatgcatatactcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgaaaaaacttattctgagaaagccaccgataaccatgttaatcatagctcttgccctgaaccggtgccaaatggagtgaagaaagtatctgtgagaacagcctgggagaagaataaatcagttagctatgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcaggtganatgtcttagcttgaatctgctttagaggcttgatgccagtcagtgttccagttatctaagaggggtttaaaaaatcatggcacagtgaaaattagacacactgaagcagcagtcaaaacttttagcttttacgggaagtgtttgattatagcaattttataactgcaagctagctttcaggaataaaaattgattttacctttagacttagagaagaaggtgttcatgcccttgtattttcaagaaactaacttgagagcaaatggcaatatgcttttcaacagattttacactaagttagtgctcacagattgcctctctttttgtttgatttctccctcctcaaatctgtaatttatttctgaactcctttccattagcaagcagataaaatggttacactttggaaactgaatagctgtagaggttcaaaaagtgagccgtaggccgggcgcaggggctcacgcctataatcccagcactttgggaggctgaggctggtgtatcacctgaggtcaggagttccagccactgtgcccagcccccaacttctttttttctgactttgtctttttgttctgataaatattagtcaataatttataggccgggcgtggtggctcatgccggtaatcccagcactttgggaggctgatgcaggcgggtcacctgaggtcaggagttcgagaccagcctggcccacatggtgaaaccccgtctctactaaagtacaaaaattagccgggcatggtgtgggggtgggcgcctgtaattccagctactcgggaggctgaggcaggagaattgctcgaacctggaaggtggaggttgcagtgagccaagatggtgccactgcactccagcctgggtaatagagcaagactcagtcttaaaaaaaaaaataaataaactttcaattgaacttttcatgttatgaaatatctttctataacatccttttaaattaacgtacaatattccatcagcagtaacgtatttaaccaagaatgttttagtagaaatttgggttgcttctaattttggatatcataaataaggctgcaataaagttcttaaacat

SEQ ID NO: 298869 - DNA, 4899 bp, Homo sapiens
acatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccagtctaatactagtaatgagatgaagctaccgtcactgaaggatatttattataaaaaacaaagggaaaacaagcagttacctgagaggaatctcacttctgcttccaacccaaatcatccaccagaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggtacagccaacagtgtcccagaatgcatttcattgacttccttggaagatcctgtgatattgtctaagattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatcttttaggagagtatgagtcccttggaaaagaacacaggagagtaaaggatgcattaaatacaactgagaataaattgcttgatgcatatactcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgatttgatatacttttggatgatttagatactgttcctgtgtctacattacaacgtaccaatccaagaaagcaactccagtttcttcctctagatgactcggaagaaaaaacttattctgagaaagccaccgataaccatgttaatcatagctcttgccctgaaccggtgccaaatggagtgaagaaagtatctgtgagaacagcctgggagaagaataaatcagttagctatgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcagctgtgaagagggataccaaggaaagttctttctgctgtctttctctttggtaatgcttatcttatgaacactcaactgaaaaaacactccacctaaaagcaggaaagatggcaattctaaatagcagctattatccccgggtataaactatttttgttgttggcttggggctttgctgcaggtattaatagtttaaagaaaaaaaaaaaaaaaaccctaagcaaatctgccacctctgggaagtgccttttaaaatgcaaatagaaagtgaactctcccctgatgcctggatctgcccccttcctttcccttgctaagcctctgtttgcaggagctactcctgaggtatggaaatggtctttgcaactgaaggacttttccaactgaagcaacagttgtagctaaagtggccgtgctagggttgtgcagagctgggctcaggggacaagaaaggagagacttggagccagagagacctgggtcacatcctggcacaggcctgcctttctcagctataagatgaaataagaaaactcctttcattaagggagattttgtaaagtgcctggtgcttagtaagtgctcaagaaatattatatttcagattcattgagttaagtaggtttttgaggtagcatccttttttttttttttttggaaagggagtctcaagttctggtgtggcccaggctggggagtgcagtgggtgtggatactgggctcactggcaacctggtctccggggttccaagctattctcctggcctaagcctcccgtgtaggtgggattacaggtgcataccacgcctggttaatttttgtattttcggtagagacggggttctcaccatgttggccatcctggtcttgaacttctgaccccaaatgatctgcctgccttggcctcccaaagtgttgggattacaggcgtgagccactgcgcccagccttgaggtagcatactttctgaaataaaaaagtagattatgtccgaagcagttgacctaaaaactgccttggactgacatttgttaggtggtctaagatgttctcttcacgctttgcaaaaaaatgagcttttttggagtttaaattaagcatccctctggtgtgtttggttttttagccaccaaaaatttaacaaatttgataacctgtcacgtgtaagttcagaaagcactttggtcttaattggtgacttgggggttatttggtataaatataggttctttttctaaaaattattgccagtatcctccaaataattgccccttcaaatgtttcatctaaaggtgacagcttgtgggcagaaccatgcacaggaagtgcctgccagtgggtgttaggagatgtaggtggagtctgtgatagccaaccaaaagctatccccttctcgcccagaaaagccacgtgctttgctggacgctacttgaaatctgaactctgcacctacatatgtagtaaaattagagacttttgtcactttaatttttagattatctcaagttttcactagatttcaatgtgccacttgtgctatgagtctttaagaagctttaaaaaataaatgcacacctgtagccttttaccattcagacaggtagattatatttacctgtcatgagggaccatgtatggttgacagttgcaggtttgattaaatccactatattgcacaaattttgctggaaataatttcctgccctgccaagagctctatggtagtttgataataaactactaccccagtattcttaggaactgtgttactaagtcttttctgcctgatttgtactttatttccatagacccctcagatatgtgaggaatcaagccataaatgtgcatttgctggacattatgtaccatgtcatctctatgactacagatttcaaggataatttttacatctaacaatttcactgtaacagtgaccgataatgtgagaaatgtgctttttacagtgctgctggtgggtagacaagtgcttgctgcagttgtttctgaatctagccagatgctggagtcgtgaagctgtaagctccgcgggagcagggaccatctctctttcttgcactacaggcactcaataaatacttgtggctgtgaa

SEQ ID NO: 298870 - DNA, 3091 bp, Homo sapiens
acatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccagtctaatactagtaatgagatgaagctaccgtcactgaaggatatttattataaaaaacaaagggaaaacaagcagttacctgagaggaatctcacttctgcttccaacccaaatcatccaccagaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggtacagccaacagtgtcccagaatgcatttcattgacttccttggaagatcctgtgatattgtctaagattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatcttttaggagagtatgagtcccttggaaaagaacacaggagagtaaaggatgcattaaatacaactgagaataaattgcttgatgcatatactcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgatttgatatacttttggatgatttagatactgttcctgtgtctacattacaacgtaccaatccaagaaagcaactccagtttcttcctctagatgactcggaagaaaaaacttattctgagaaagccaccgataaccatgttaatcatagctcttgccctgaaccggtgccaaatggagtgaagaaagtatctgtgagaacagcctgggagaagaataaatcagttagctatgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcagacccctcagatatgtgaggaatcaagccataaatgtgcatttgctggacattatgtaccatgtcatctctatgactacagatttcaaggataatttttacatctaacaatttcactgtaacagtgaccgataatgtgagaaatgtgctttttacagtgctgctggtgggtagacaagtgcttgctgcagttgtttctgaatctagccagatgctggagtcgtgaagctgtaagctccgcgggagcagggaccatctctctttcttgcactacaggcactcaataaatacttgtggctgtgaa

SEQ ID NO: 298871 - DNA, 1375 bp, Homo sapiens
tttcttagagatttcaattgcttttaaaagtttgggaagccctctctttggttctttaatgtcttaattttgagaacctgacttttattttactttgaaaggctactacttttagaatattttacttccatgagctctgccaagcttccccacctgtgctcagtggcacagtatgggtttgtgggattacaggcgtgagccactgcgcccagccttgaggtagcatactttctgaaataaaaaagtagattatgtccgaagcagttgacctaaaaactgccttggactgacatttgttaggtggtctaagatgttctcttcacgctttgcaaaaaaatgagcttttttggagtttaaattaagcatccctctggtgtgtttggttttttagccaccaaaaatttaacaaatttgataacctgtcacgtgtaagttcagaaagcactttggtcttaattggtgacttgggggttatttggtataaatataggttctttttctaaaaattattgccagtatcctccaaataattgccccttcaaatgtttcatctaaaggtgacagcttgtgggcagaaccatgcacaggaagtgcctgccagtgggtgttaggagatgtaggtggagtctgtgatagccaaccaaaagctatccccttctcgcccagaaaagccacgtgctttgctggacgctacttgaaatctgaactctgcacctacatatgtagtaaaattagagacttttgtcactttaatttttagattatctcaagttttcactagatttcaatgtgccacttgtgctatgagtctttaagaagctttaaaaaataaatgcacacctgtagccttttaccattcagacaggtagattatatttacctgtcatgagggaccatgtatggttgacagttgcaggtttgattaaatccactatattgcacaaattttgctggaaataatttcctgccctgccaagagctctatggtagtttgataataaactactaccccagtattcttaggaactgtgttactaagtcttttctgcctgatttgtactttatttccatagacccctcagatatgtgaggaatcaagccataaatgtgcatttgctggacattatgtaccatgtcatctctatgactacagatttcaaggataatttttacatctaacaatttcactgtaacagtgaccgataatgtgagaaatgtgctttttacagtgctgctggtgggtagacaagtgcttgctgcagttgtttctgaatctagccagatgctggagtcgtgaagctgtaagctccgcgggagcagggaccatctctctttcttgcactacaggcactcaataaatacttgtggctgtgaa

SEQ ID NO: 298872 - DNA, 4091 bp, Homo sapiens
  misc_feature (2794)..(2794): n is a, c, g, or t
acatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccagtctaatactagtaatgagatgaagctaccgtcactgaaggatatttattataaaaaacaaagggaaaacaagcagttacctgagaggaatctcacttctgcttccaacccaaatcatccaccagaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggtacagccaacagtgtcccagaatgcatttcattgacttccttggaagatcctgtgatattgtctaagattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatcttttaggagagtatgagtcccttggaaaagaacacaggagagtaaaggatgcattaaatacaactgagaataaattgcttgatgcatatactcagatttctgatttgaaaagaatgatttcaaaacttgaagctcaggtcaagcaagtagaacatgaaaatatgttaagccttcgtcataattctagaattcacgtgagaccctcgcgtgccaacacactagcaacttcagacgtcagcaggcggaaatggctgattccaggtgcagagtattccatctttactggccagcctctggacacccaggacagtaacgtggataaccagctggaggaaacctgtagcctagggcaccgttcacctctggaaaaggattcttcacctggaagttcatcaacaagcttgttgataaaaaagcaaagagagacttcagacacgccgatcatgagagctttaaaagaacttgatgagggaaaaatatttaaaaattgggggacacagacagagaaagaggacacctcaaatataaatcctcggcaaactgaaacttcagttaatgcaagtcgttctccagaaaagtgtgcccaacagagacaaaagagacttaattcggcctcacagagatcatcatctttaccaccttcaaatcgtaaatcaagtactccaacaaaaagagagattatgctaacaccagtgactgtggcttatagtccaaagcgatcccctaaagaaaacttgtccccaggatttagtcatctgcttagcaaaaatgagagcagtccaattcgatttgatatacttttggatgatttagatactgttcctgtgtctacattacaacgtaccaatccaagaaagcaactccagtttcttcctctagatgactcggaagaaaaaacttattctgagaaagccaccgataaccatgttaatcatagctcttgccctgaaccggtgccaaatggagtgaagaaagtatctgtgagaacagcctgggagaagaataaatcagttagctatgaacagtgtaagccggtttcagtcactccacaggggaatgattttgaatatacagcaaaaattcggaccctagctgaaacagaacgattttttgatgaacttacaaaagaaaaggaccagattgaggcagcactaagcaggatgccttctcctggaggacgaatcactttacagacaagattaaatcaggtganatgtcttagcttgaatctgctttagaggcttgatgccagtcagtgttccagttatctaagaggggtttaaaaaatcatggcacagtgaaaattagacacactgaagcagcagtcaaaacttttagcttttacgggaagtgtttgattatagcaattttataactgcaagctagctttcaggaataaaaattgattttacctttagacttagagaagaaggtgttcatgcccttgtattttcaagaaactaacttgagagcaaatggcaatatgcttttcaacagattttacactaagttagtgctcacagattgcctctctttttgtttgatttctccctcctcaaatctgtaatttatttctgaactcctttccattagcaagcagataaaatggttacactttggaaactgaatagctgtagaggttcaaaaagtgagccgtaggccgggcgcaggggctcacgcctataatcccagcactttgggaggctgaggctggtgtatcacctgaggtcaggagttccagccactgtgcccagcccccaacttctttttttctgactttgtctttttgttctgataaatattagtcaataatttataggccgggcgtggtggctcatgccggtaatcccagcactttgggaggctgatgcaggcgggtcacctgaggtcaggagttcgagaccagcctggcccacatggtgaaaccccgtctctactaaagtacaaaaattagccgggcatggtgtgggggtgggcgcctgtaattccagctactcgggaggctgaggcaggagaattgctcgaacctggaaggtggaggttgcagtgagccaagatggtgccactgcactccagcctgggtaatagagcaagactcagtcttaaaaaaaaaaataaataaactttcaattgaacttttcatgttatgaaatatctttctataacatccttttaaattaacgtacaatattccatcagcagtaacgtatttaaccaagaatgttttagtagaaatttgggttgcttctaattttggatatcataaataaggctgcaataaagttcttaaacatatctctttgcacgtgtaagtattgccttaggagtcattcccagaaataaaaatgctaggtccaaagaaatgcaaatttctaaggatttggatatatgtcaagttgtaacccaggatgtttgagacaatttctactcctacctgccgtgtatgaagataagctcttccccatcctgaaacctgtatgtttgggaaaacaacaacaacaaaaaaaaca

SEQ ID NO: 298873 - DNA, 1272 bp, Homo sapiens
acatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccagtctaatactagtaatgagatgaagctaccgtcactgaaggatatttattataaaaaacaaagggaaaacaagcagttacctgagaggaatctcacttctgcttccaacccaaatcatccaccagaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggtacagccaacagtgtcccagaatgcatttcattgacttccttggaagatcctgtgatattgtctaagtatgtatttcagtgaatggcttgtaatgttaatagattttctgtgatatctgattgaaaatgatctttattgaacttcagtattgcataaagtcttagagatttagcatttttaagatggagcatataaaaactttttcacttgattgtta

SEQ ID NO: 298874 - DNA, 1780 bp, Homo sapiens
acatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccagtctaatactagtaatgagatgaagctaccgtcactgaaggatatttattataaaaaacaaagggaaaacaagcagttacctgagaggaatctcacttctgcttccaacccaaatcatccaccagaggtcctgactctagatcctacgttacacatgaagccaaagcagcagatttcagggattcaacctcacggccttccgaatgcccttgatgacagaatatccttttccccggactctgttctagagcctagtatgtctagtccctctgacatagactcattttcacaagcaagtaatgtcacttctcagttacctggatttccaaaatatccctcacacacaaaagcttctccggtggactcttggaaaaatcagacattccaaaacgaaagtaggaccagttccacgtttccgtcagtatataccattactagtaatgatatctcggtcaacactgtagatgaagaaaacactgtcatggttgcttcggcctcagtcagtcagtcccagcttccaggattaggcagaatctgaaggaaaagcatgctcgacacatagcagatcttcgagcttattatgaatcagaaataaatagtttgaaacagaagctggaggcaaaagaaatctctggagttgaagattggaagataaccaatcaaattcttgtagacagatgtggccaattagatagtgctttgcatgaagctactagtcgcgtgagaacacttgaaaataagaataacttactggaaattgaagtgaatgatttgagagaacgcttcagtgcagccagcagtgcttccaaaattttgcaggaacgaattgaagaaatgagaacaagcagtaaagaaaaagacaataccatcattcgactaaaatctagactgcaagatttagaagaagcatttgagaatgcttacaaactctcagatgataaagaagctcaactaaaacaagagaacaaaatgtttcaagatgtaagtagcgaataatagtaacttaatgacgtgattggctaaaagtaatttaggtattatactcttacaagtgattatgactttctaggcttattttattatttattgatttattttgagacagagtctcgctctgacacccaggctggagtgcagtggcaggagctcaactcactgcagcctccacctcccgggctcaggagatcttctcgcctcagcctcccaagtagctggaattacaggagcccaccactgctggccggctaa

SEQ ID NO: 298875 - DNA, 1106 bp, Homo sapiens
  misc_feature (1041)..(1041): n is a, c, g, or t
  misc_feature (1068)..(1068): n is a, c, g, or t
acatagatgttcccaaaggacagtatgtagcacctgcggtgccggctgagtcacttgtagatggtgtgaaaaatgagaatttttatatacagactcctgaagagtgtcatgtgtctttaaaggaagatgtatccatttctcctggtgaatttgaacataattttcttggtgaaaataaggtttctgaagtatacagtgggaaaacaaatagtaatgctataacatcatgggcacaaaaactgaagcagaaccaaccaaagagagcacatgtagaagatggaggttcaagatctaaacaaggaaatgagcaaagtaagaagacaccaattgagaaatctgattttgctgctgctacacatcctcgtgctttttacctcagtaaaccagatgaaactccaaatgcttggatgtctgattcaggaacaggattgacttactggaaactagaggaaaaggatatgcaccactctttgcctgaaactttagagaagacgttcatatcattgtcttccacagatgtgtcaccaaaccagtctaatactagtaatgagatgaagctaccgtcactgaaggatatttattataaaaaacaaagggaaaacaagcagttacctgagaggaatctcacttctgcttccaacccaaatcatccaccagaggtaaagttgtccacattctgccgagtgaacgtgaacaatgcttcctgactctaacttttacctcaagcttcattttccctaggagatctaaagcctactcacttcaaaacaagcaaaacaaagccgagttctgagggtaagacttcgttgttgtctggtttccaggtcctgactctagatcctacgtaggctgcagacaccatgaaataatttaagcccaaagttttaatgtttagagcctagacctctctgcaacatttttagtgtagtgaggtcctgatttcaatttttcgaaattagggtcctatcttctgttttttgagacagagttttgctctgtcgcccaggctagagcagagatggagttttgcccttgttgcantgagctgagatctgccactgcactccngcctgggtgacagagcaagactccctcaaaacccataa

SEQ ID NO: 298876 - DNA, 380 bp, Homo sapiens
attggtcctcaggagcttcattgtagtgtgtaggtttgtcttccaagctgctgatacctatttggccaattttgagctcatgagcagggaatgacagtctgtcacaaccacaacttggcccaaagcaatagcaattataaaatgccattaattacaagaggcatccctactttagagatgttaacatgacaagaacataaaagtggtgaaaagtggtacttttctattcccatgagctttgagtagaataaccccaactattcccccagaccaccaggctgtggccatagctggagtaatgctactcttcacaggcttcaggtcttgaaaaggcttctttaggttattggcatgtaaagaatgaattctacagcaggatt

SEQ ID NO: 298877 - DNA, 493 bp, Homo sapiens
ttcatttatgtttacatgaagtttgcttaagttcattaagggaagttgcaaagattgtcaaacagagggcaaagctttcagaattctttggagaaaaaagcactgagtaaataagattgattattgtatctcttttcattacttttttgggccacatagcagctatatccagaaagtgaaattgggcaacatatttaatatatgtgcaacctacacgaaaaattgataagaaatataagcaatttctctcctctctgacagaaaaaacttattctgagaaagccaccgataaccatgttaatcatagctcttgccctgaaccggtgccaaatggagtgaagaaagtatctgtgagaacagcctgggagaagaataaatcagttagctatgaacagtgtaagccggtttcagtcactccacaggggaatgattttgaatatacagcaaaaattcggaccctagctgaaacagaacgattttttgatgaacttac

SEQ ID NO: 298878 - DNA, 638 bp, Homo sapiens
ctcagtctagcttgtcagagtagcctcaataccggctatagaacctgctttatatatgctgagcgttcaataagttcttgatgaaaaagtaatagaagatatttcttgtgcctctcagttctgtcatcagttggttccgttccatttgtttctctcacagtcgggggtgatatgtgtgtgcacgcctacctcagcgggcagcccttggaggaatcacagctgagcatgctggcctgcttcctcgtctaccactctgtgccagctccacagcacctgccacctataggactagaagggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaacaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttcca

SEQ ID NO: 298879 - DNA, 2032 bp, Homo sapiens
aacataaatcaccaagttatcaaatcaaagaaggagataccataaatgtggatgtgacttgtccaggtgctactctagctttggctatgatctacttaaaaaccaataacagatctattgcagattggctccgagcccctgacaccatgtatttgttggactttgtgaagccagaatttctcttgcttaggacacttgctcgatgcctgattttgtgggatgatattttaccaaattccaagtgggttgacagcaatgttcctcaaattataagagaaaatagtatctctctcagtgaaatcgaattgccgtgctcagaggatttgaatttggaaactttgtcccaagcacatgtctacataattgcaggagcctgcttgtctctgggttttcgatttgctggctcagaaaacttatcagcatttaactgtttgcataaatttgccaaagattttatgacttatttgtccgcacctaatgcttctgttacaggtcctcataacctagaaacttgtctgagcgtggtgctgctgtctctcgccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtactctttgagcacatcaaattcttccattgccgctcttctctgtgccctttatccgcacttcccagctcacagcactgacaaccggtatcatctccaggctctccggcacctctatgtgctggccgcggagcccaggcttctagtgcctgtggatgtggacacaaacacgccctgctatgccctcttagaagttacctacaagggcactcagtggtatgaacaaaccaaagaagaattgatggctcctacccttcttccagaactccatcttttaaagcagattaaagtaaaaggcccaagatactgggaactgctcatagatttaagcaaaggaacacaacacttgaagtccatcctttccaaggatggggttttatatgttaaactccgggcgggtcagctctcctacaaagaagatccaatgggatggcaaagtttgttggctcagactgttgctaacaggaactctgaagcccgggctttcaagccagaaacaatctcagcattcacttctgatccagcacttctgtcatttgctgaatatttctgcaagccaactgtgaacatgggtcagaaacaggaaattctggatctcttttcttcagtactctatgaatgtgttacccaggagaccccagagatgttgcctgcatacatagcaatggatcaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaagtcgggggtgatatgtgtgtgcacgcctacctcagcgggcagcccttggaggaatcacagctgagcatgctggcctgcttcctcgtctaccactctgtgccagctccacagcacctgccacctataggactagaagggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaacaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttcca

SEQ ID NO: 298880 - DNA, 3464 bp, Homo sapiens
aacataaatcaccaagttatcaaatcaaagaaggagataccataaatgtggatgtgacttgtccaggtgctactctagctttggctatgatctacttaaaaaccaataacagatctattgcagattggctccgagcccctgacaccatgtatttgttggactttgtgaagccagaatttctcttgcttaggacacttgctcgatgcctgattttgtgggatgatattttaccaaattccaagtgggttgacagcaatgttcctcaaattataagagaaaatagtatctctctcagtgaaatcgaattgccgtgctcagaggatttgaatttggaaactttgtcccaagcacatgtctacataattgcaggagcctgcttgtctctgggttttcgatttgctggctcagaaaacttatcagcatttaactgtttgcataaatttgccaaagattttatgacttatttgtccgcacctaatgcttctgttacaggtcctcataacctagaaacttgtctgagcgtggtgctgctgtctctcgccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtactctttgagcacatcaaattcttccattgccgctcttctctgtgccctttatccgcacttcccagctcacagcactgacaaccggtatcatctccaggctctccggcacctctatgtgctggccgcggagcccaggcttctagtgcctgtggatgtggacacaaacacgccctgctatgccctcttagaagttacctacaagggcactcagtggtatgaacaaaccaaagaagaattgatggctcctacccttcttccagaactccatcttttaaagcagattaaagtaaaaggcccaagatactgggaactgctcatagatttaagcaaaggaacacaacacttgaagtccatcctttccaaggatggggttttatatgttaaactccgggcgggtcagctctcctacaaagaagatccaatgggatggcaaagtttgttggctcagactgttgctaacaggaactctgaagcccgggctttcaagccagaaacaatctcagcattcacttctgatccagcacttctgtcatttgctgaatatttctgcaagccaactgtgaacatgggtcagaaacaggaaattctggatctcttttcttcagtactctatgaatgtgttacccaggagaccccagagatgttgcctgcatacatagcaatggatcaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaagtcgggggtgatatgtgtgtgcacgcctacctcagcgggcagcccttggaggaatcacagctgagcatgctggcctgcttcctcgtctaccactctgtgccagctccacagcacctgccacctataggactagaagggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaacaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttccaaaaaaaatgatgattgctttagttttggacttagagaatagagcaggggttgctggagtgaatattgatttttaaagtctttgaactgtggtggtataggtgaagtgactatgcccaaaaatgccaagttttaaaagaagctatgtcataaagttttactttctgtggcaaaagagcgctttagcatttcctcagatgtcacagttgtcctgtctaaaataagtttgtacttctggtgacaatgccagacactcttatgatgtgatcaccttaaacaggagaaggagatttttgccctcagttgctcaacatgaagtactgtggactgaattgtgtcctcccagaattatatattgaggccctaatccctgtgtgactgtattaggcaatagggcatataggagattactaaggttaagtgaggtcatcataagggtggggccttaattcagtagaattggtggcctcctaagcagaggaagagagatttttctttctctctctgccatgtgaagacagtgaggagtcggccgtctgcaagccaagaagagcccttatcaggaacagacttggctagcaccttcatcgtggacctccagcctccagaattgcaagaaaatacatttccgtcgttgaaaccacccagtctgtggtattttgttatggcagcccaggcagactaatacgtgaagcctgctctaaatagataaaataagaaattactacagagggctctttagaaattgtatttaaaaacaagacaatccatatttacctaagatttacagaatgtatgtctataaaaggagggatttctggactagatgatgatgaaaaatgttcatataaaggcacctccagcttcgagttgccaacacaggaggaagaatgctccctgctgttcagatgctgatatgtgtcctgtgcttcctggatggccagtgggatcataagctggtagaagcaagaccttcatccactgacttcatatttcttccacatcctgaactgtggtgtttgactttaaaaataaattaaagcaaatagaaatgtttccattgagattttggcaaaaacccacatgacatttgcgtctgcagagtagacttggaaggcatgcacctggaggccaagtggtattctctggactctctgtccttgcatttgcgtggctgccccgaggactcgcttcttcctggatgtgaagcagaggcacgatggggctgactgagaggctgaaatgtgcttctcttcacagttacatagttttcttctaattaaaaataaattttaagtggtagattatgaaaattccatttgaatcaagattttaaaaattcaatatcaaaccagttgttactgtcttcactctccgttgtttacgattgtgtgcttttcctgaataaagaatgactggagagacaaaaaaaaa

SEQ ID NO: 298881 - DNA, 1615 bp, Homo sapiens
cggacgcgtgggtcgactgtcggcaagagattttatgacttatttgtccgcgagcctaactgcgttctgttacaggtcctcataacctagaaacttgtctgagcgtggtgctgctgtctctcgccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtactctttgagcacatcaaattcttccattgccgctcttctctgtgccctttatccgcacttcccagctcacagcactgacaaccggtatcatctccaggctctccggcacctctatgtgctggccgcggagcccaggcttctagtgcctgtggatgtggacacaaacacgccctgctatgccctcttagaagttacctacaagggcactcagtggtatgaacaaaccaaagaagaattgatggctcctacccttcttccagaactccatcttttaaagcagattaaagtaaaaggcccaagatactgggaactgctcatagatttaagcaaaggaacacaacacttgaagtccatcctttccaaggatggggttttatatgttaaactccgggcgggtcagctctcctacaaagaagatccaatgggatggcaaagtttgttggctcagactgttgctaacaggaactctgaagcccgggctttcaagccagaaacaatctcagcattcacttctgatccagcacttctgtcatttgctgaatatttctgcaagccaactgtgaacatgggtcagaaacaggaaattctggatctcttttcttcagtactctatgaatgtgttacccaggagaccccagagatgttgcctgcatacatagcaatggatcaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaagtcgggggtgatatgtgtgtgcacgcctacctcagcgggcagcccttggaggaatcacagctgagcatgctggcctgcttcctcgtctaccactctgtgccagctccacagcacctgccacctataggactagaagggagcacaagctttgctgaactgctcttcaaatttaagcagctaaaaatgccagtgcgagctttgctgagattggctcctttgcttcttggaaatccacagccaatggtgatgtgaccgtgtctggcggtgaacctaccctgaaacgtgacttctgcacaacaaacgtgaccaaacatcaaagctaaagcaatgtttataaagttttatggtataactagggggaaatgagctgcacaaacctcaatgtattttaaatctgttgctgtcatcattaacggtatatgacatataaaagcaagttaaaatttacttttgtaaataaagtttttggtttgtttcca

SEQ ID NO: 298882 - DNA, 1836 bp, Homo sapiens
aacataaatcaccaagttatcaaatcaaagaaggagataccataaatgtggatgtgacttgtccaggtgctactctagctttggctatgatctacttaaaaaccaataacagatctattgcagattggctccgagcccctgacaccatgtatttgttggactttgtgaagccagaatttctcttgcttaggacacttgctcgatgcctgattttgtgggatgatattttaccaaattccaagtgggttgacagcaatgttcctcaaattataagagaaaatagtatctctctcagtgaaatcgaattgccgtgctcagaggatttgaatttggaaactttgtcccaagcacatgtctacataattgcaggagcctgcttgtctctgggttttcgatttgctggctcagaaaacttatcagcatttaactgtttgcataaatttgccaaagattttatgacttatttgtccgcacctaatgcttctgttacaggtcctcataacctagaaacttgtctgagcgtggtgctgctgtctctcgccatggtcatggctggctcaggaaacctaaaggttttgcagctttgtcgcttcttacacatgaaaacgggtggtgaaatgaactatggttttcacttagcccaccacatggcccttggacttctatttttgggaggaggaaggtactctttgagcacatcaaattcttccattgccgctcttctctgtgccctttatccgcacttcccagctcacagcactgacaaccggtatcatctccaggctctccggcacctctatgtgctggccgcggagcccaggcttctagtgcctgtggatgtggacacaaacacgccctgctatgccctcttagaagttacctacaagggcactcagtggtatgaacaaaccaaagaagaattgatggctcctacccttcttccagaactccatcttttaaagcagattaaagtaaaaggcccaagatactgggaactgctcatagatttaagcaaaggaacacaacacttgaagtccatcctttccaaggatggggttttatatgttaaactccgggcgggtcagctctcctacaaagaagatccaatgggatggcaaagtttgttggctcagactgttgctaacaggaactctgaagcccgggctttcaagccagaaacaatctcagcattcacttctgatccagcacttctgtcatttgctgaatatttctgcaagccaactgtgaacatgggtcagaaacaggaaattctggatctcttttcttcagtactctatgaatgtgttacccaggagaccccagagatgttgcctgcatacatagcaatggatcaggctataagaagacttgggagaagagaaatgtctgagacttctgaactttggcagataaagttggtgttagagtttttcagctcccgaagccatcaggagcggctgcagaaccaccctaagcgggggctctttatgaactcggaattcctccctgttgtgaagtgcaccattgataataccctggaccagtggctacaagtcgggggtgatatgtgtgtgcacgcctacctcagcgggcagcccttggaggaatcacagctgagcatgctggcctgcttcctcgtctaccactctgtgccagctccacagcacctgccacctataggactagaaggtcttctgaaggacctagcaggagactcaggttgaaaccctacagaacctcgccgtgtgccgccgagtcttccttgaataaggccattttctcaccctttgtctagtaactagctgactccacagctcatggtaaggggcatgtctc

SEQ ID NO: 298883 - DNA, 110 bp, Homo sapiens
cctcacattaaagtgggtttatgaccatgaacacttcgtattaataaatgtctcagcacacccaagcctgaaaatctgatctaaacctccttaacttgaattccatccac

SEQ ID NO: 298884 - DNA, 5764 bp, Homo sapiens
ctcccgcttctcctcctcctcctccacagttgcctgccctgggcgggggcgagcgcgtccggtttgctggaagcgttcggaaatggcaacttgcgcggtggaggtgttcgggctcctggaggacgaggaaaattcacgaattgtgagagtaagagttatagccggaataggccttgccaagaaggatatattgggagctagtgatccttacgtgagagtgacgttatatgacccaatgaatggagttcttacaagtgtgcaaacaaaaaccattaaaaagagtttgaatccaaagtggaatgaagaaatattattcagagttcatcctcagcagcaccggcttctttttgaagtgtttgacgaaaaccgattgacaagagatgatttcctaggtcaagtggatgttccactttatccattaccgacagaaaatccaagattggagagaccatatacatttaaggattttgttcttcatccaagaagtcacaaatcaagagttaaaggttatctgagactaaaaatgacttatttacctaaaaccagtggctcagaagatgataatgcagaacaggctgaggaattagagcctggctgggttgttttggaccaaccagatgctgcttgccatttgcagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccaccaggcggcagatatccgaggaaacagaaagtgttgacaaccaagagtcttccgagaactgggaaattataagagaagatgaagccaccatgtatagcagccaggccttcccatcacctccaccgtcaagtaacttggatgttccaactcatcttgcagaagaattgaatgccagactcaccatttttggaaattcagccgtgagccagccagcatcgagctcaaatcattccagcagaagaggcagcttacaagcctatacttttgaggaacaacctacacttcctgtgcttttgcctacttcatctggattaccaccaggttgggaagaaaaacaagatgaaagaggaagatcatattatgtagatcacaattccagaacgactacttggacaaagcccactgtacaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttatcttgtaatacaatggcgatttgtaaaccgaatccagaagcaaatggctgcttttaaagagggattctttgaactaataccacaggatctcatcaaaatttttgatgaaaatgaactagagcttcttatgtgtggactgggagatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcattctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgtggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatgtatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtgtaaaatcattttttaaaatcttgaatccacaaataaagttctattctgattttaaaaaacaaaaaaaaa

SEQ ID NO: 298885 - DNA, 942 bp, Homo sapiens
ctcccgcttctcctcctcctcctccacagttgcctgccctgggcgggggcgagcgcgtccggtttgctggaagcgttcggaaatggcaacttgcgcggtggaggtgttcgggctcctggaggacgaggtaggccctgctaattgcagatttctcatctcaccgccttccagcagagccagttgatcttaaagaaaatagtgccaaagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaaga

SEQ ID NO: 298886 - DNA, 4601 bp, Homo sapiens
catttcctaaagagcggggcaaaagaaatgaccagttagtggtgatccctgagaactgatcgttattccttttgatattatagcctgacagtgatagattttagaaggagaaaatattgtgtcacatatttaggaaataaagtataaattgacttttacaagagaatattttaaatatccattgatgttagaaaacatggtaacagactgactttgattattttaaaatttgtgtgtattgttctttatttactctaccaaaaaaggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttatcttgtaatacaatggcgatttgtaaaccgaatccagaagcaaatggctgcttttaaagagggattctttgaactaataccacaggatctcatcaaaatttttgatgaaaatgaactagagcttcttatgtgtggactgggagatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcattctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgtggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatgtatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtgtaaaatcattttttaaaatcttgaatccacaaataaagttctattctgattttaaaaaacaaaaaaaaa

SEQ ID NO: 298887 - DNA, 5667 bp, Homo sapiens
ctcccgcttctcctcctcctcctccacagttgcctgccctgggcgggggcgagcgcgtccggtttgctggaagcgttcggaaatggcaacttgcgcggtggaggtgttcgggctcctggaggacgaggaaaattcacgaattgtgagagtaagagttatagccggaataggccttgccaagaaggatatattgggagctagtgatccttacgtgagagtgacgttatatgacccaatgaatggagttcttacaagtgtgcaaacaaaaaccattaaaaagagtttgaatccaaagtggaatgaagaaatattattcagagttcatcctcagcagcaccggcttctttttgaagtgtttgacgaaaaccgattgacaagagatgatttcctaggtcaagtggatgttccactttatccattaccgacagaaaatccaagattggagagaccatatacatttaaggattttgttcttcatccaagaagtcacaaatcaagagttaaaggttatctgagactaaaaatgacttatttacctaaaaccagtggctcagaagatgataatgcagaacaggctgaggaattagagcctggctgggttgttttggaccaaccagatgctgcttgccatttgcagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccaccaggcggcagatatccgaggaaacagaaagtgttgacaaccaagagtcttccgagaactgggaaattataagagaagatgaagccaccatgtatagcagccaggccttcccatcacctccaccgtcaagtaacttggatgttccaactcatcttgcagaagaattgaatgccagactcaccatttttggaaattcagccgtgagccagccagcatcgagctcaaatcattccagcagaagaggcagcttacaagcctatacttttgaggaacaacctacacttcctgtgcttttgcctacttcatctggattaccaccaggttgggaagaaaaacaagatgaaagaggaagatcatattatgtagatcacaattccagaacgactacttggacaaagcccactgtacaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttatcttgtaatacaatggcgatttgtaaaccgaatccagaagcaaatggctgcttttaaagagggattctttgaactaataccacaggatctcatcaaaatttttgatgaaaatgaactagagcttcttatgtgtggactgggagatgttgatgtgaatgactggagggaacatacaaagtataaaaatggctacagtgcaaatcatcaggttatacagtggttttggaaggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcattctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgtggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatgtatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtgtaaaatcattttttaaaatcttgaatccacaaataaagttctattctgattttaaaaaacaaaaaaaaa

SEQ ID NO: 298888 - DNA, 3497 bp, Homo sapiens
tttgatgagatcctgtggtattagttcaaagaatccctctttaaaagcagccatttgcttctggattcggtttacaaatcgccattgtattacaagataaatatattcctttttgttcttattggtgacaactatttctgatccaccatttttcagctcatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcattctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgtggggtataacatgatgagtactcattagcacctgatagaaatctgaaatgtgacagtagcaaaaccactttctactttccaaacaccacagcatcagcatggtttaggggaagcaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatgtatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtgtaaaatcattttttaaaatcttgaatccacaaataaagttctattctgattttaaaaaacaaaaaaaaa

SEQ ID NO: 298889 - DNA, 5709 bp, Homo sapiens
ctcccgcttctcctcctcctcctccacagttgcctgccctgggcgggggcgagcgcgtccggtttgctggaagcgttcggaaatggcaacttgcgcggtggaggtgttcgggctcctggaggacgaggaaaattcacgaattgtgagagtaagagttatagccggaataggccttgccaagaaggatatattgggagctagtgatccttacgtgagagtgacgttatatgacccaatgaatggagttcttacaagtgtgcaaacaaaaaccattaaaaagagtttgaatccaaagtggaatgaagaaatattattcagagttcatcctcagcagcaccggcttctttttgaagtgtttgacgaaaaccgattgacaagagatgatttcctaggtcaagtggatgttccactttatccattaccgacagaaaatccaagattggagagaccatatacatttaaggattttgttcttcatccaagaagtcacaaatcaagagttaaaggttatctgagactaaaaatgacttatttacctaaaaccagtggctcagaagatgataatgcagaacaggctgaggaattagagcctggctgggttgttttggaccaaccagatgctgcttgccatttgcagcaacaacaagaaccttctcctctacctccagggtgggaagagaggcaggatatccttggaaggacctattatgtaaaccatgaatctagaagaacacagtggaaaagaccaacccctcaggacaacctaacagatgctgagaatggcaacattcaactgcaagcacaacgtgcatttaccaccaggcggcagatatccgaggaaacagaaagtgttgacaaccaagagtcttccgagaactgggaaattataagagaagatgaagccaccatgtatagcagccaggccttcccatcacctccaccgtcaagtaacttggatgttccaactcatcttgcagaagaattgaatgccagactcaccatttttggaaattcagccgtgagccagccagcatcgagctcaaatcattccagcagaagaggcagcttacaagcctatacttttgaggaacaacctacacttcctgtgcttttgcctacttcatctggattaccaccaggttgggaagaaaaacaagatgaaagaggaagatcatattatgtagatcacaattccagaacgactacttggacaaagcccactgtacaggccacagtggagaccagtcagctgacctcaagccagagttctgcaggccctcaatcacaagcctccaccagtgattcaggccagcaggtgacccagccatctgaaattgagcaaggattccttcctaaaggctgggaagtccggcatgcaccaaatgggaggcctttctttattgaccacaacactaaaaccaccacctgggaagatccaagattgaaaattccagcccatctgagaggaaagacatcacttgatacttccaatgatctagggcctttacctccaggatgggaagagagaactcacacagatggaagaatcttctacataaatcacaatataaaaagaacacaatgggaagatcctcggttggagaatgtagcaataactggaccagcagtgccctactccagggattacaaaagaaagtatgagttcttccgaagaaagttgaagaagcagaatgacattccaaacaaatttgaaatgaaacttcgccgagcaactgttcttgaagactcttaccggagaattatgggtgtcaagagagcagacttcctgaaggctcgactgtggattgagtttgatggtgaaaagggattggattatggaggagttgccagagaatggttcttcctgatctcaaaggaaatgtttaacccttattatgggttgtttgaatattctgctacggacaattataccctacagataaatccaaactctggattgtgtaacgaagatcacctctcttacttcaagtttattggtcgggtagctggaatggcagtttatcatggcaaactgttggatggttttttcatccgcccattttacaagatgatgcttcacaaaccaataacccttcatgatatggaatctgtggatagtgaatattacaattccctaagatggattcttgaaaatgacccaacagaattggacctcaggtttatcatagatgaagaactttttggacagacacatcaacatgagctgaaaaatggtggatcagaaatagttgtcaccaataagaacaaaaaggaatatatttatcttgtaatacaatggcgatttgtaaaccgaatccagaagcaaatggctgcttttaaagagggattctttgaactaataccacaggatctcatcaaaatttttgatgaaaatgaactagagcttcttatgtgtggactgggagatgttgatgtgaatgactggagggaacatacaaagtataaaaatggctacagtgcaaatcatcaggttatacagtggttttggaaggctgttttaatgatggattcagaaaaaagaataagattacttcagtttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaaacacccagggctttgatggagttgattagattacaaataacaatctgtagtgtttttactgccatagttttataaccaaaatcttgacttaaaattttccggggaactactaaaatgtggccactgagtcttcccagatcttgaagaaaatcatataaaaagcatttgaagaaatagtacgacaacttatttttaatcacttttaaataatgtgttgcatttacacagttgtttcattctgtctttagagttaggtgcctgcctaaagccaggcaccaccacacctggctttagagttcacacaataggatataagtcctgtatgacttaaatagtgaattttgtccttaacatttacctcttgtatagtatctgccaggcagttttttcttaaactactgagatgataactgtgaaatatttgtgatacgtgtcatgtgtgaaaagtttgatgcattttgagatggaaaactgaaatttggaaaaagaaatactttactattgagtaaactacaatatatttagtgctactcgcagctatttattattttgtagacctgccttatgcaccttactgcctagatttttgggaaaaaactttggaaagtgtgttacctatatttctagccaactaactcacagaaaaactgtttacttcttcactttcgaagtatttggcttttgttaatatgcagttttactaaacagatggttcataagacatgtgaagcaaattcatatttgcaatgggtaaaaagtattaaagcctttctcttgcctgcatatcctattgaccattggtatagtcatcactttttcatattttagtgtagttagaagaattccttcttcaaacattaaagatccacaaagcagtatttctaaatatgccttgaagaactaaatgaagtgtatagcacttgcctttactagatattctttacacttgtacaattatgtagtaaatgtatgtttacagggtttatcatgtttacagattaagctaatttctgtagtcgcatttttatatttttagtatcactctagtaaaaaaaccaaataatttgtttaaaataaccaaagagttgttataatgcataatttgtattaaatttattactatttcttatgccttttaaaatactgtttactatgaagacaatgtttttaattacaaatccagaattctgtaggcaaaatgctacagttcatatcttcctttaaccaaactgaagtacataaagaccatgtacatgtattcatcaaacgtttattgaatgctgcgtgcctagcgctgtgctatgctctggggtaagagttgtcagcttcagagaagctgagtcctgatcctcaaggaacttgcaaatgtgtctatgaatttgtaaaacaatcaaaagtaggcgtaagcagaataaggcaaaagggaaagtgttctaggttccagcacacctgcaaagataaagtgtgccaagactgtatttatatttcatacttatattgtttcatccttatattggaatgattatatagaaaatgctcttaaaaagattaaacctatttctcagtatggtatcttggtgatttaggaataattgtaaatatatgttacgaatcttcttaaatatatatatatacacaccctgtgagaactgtaaaaagtacctctggttcttggtttaagtttgtggggtataacatgatgagtactcattagcacctgatagaaatctgaaatgtgacagtacaattcacagattaatgtaccctgcgttttgtcttcaccattgtcaaccagcagtcaaggatgagcaccaggtatagtcctggtttgatatctcaccagccatgtgaactgaagcagcttacttaacctctctggattcatatttcttcatctgtcaaatgagagtaatcatgcccaccctcattgtcatgccagattgtcagaagttccagacagatgagaaagcaaaaagtactttgtaaagtgttatacaatcagaaggtgctttgtgctgaccgtcagattgtgtcaagtcaggtgtgcaaattgaccacactcccaaagaatcatttaaaagtaaagtgacttctaagagacaaggaagtaggaacatttctgatattaaatatataaataatatggatacacatgtgtatatctgtatatggatcttaccatcataattcattttcttcatatcagcaaagtaatagtaatgtgggccaatgcattttggaaatgtcctcattatgtagaatggaatgtgaaaattatttttgttaaaacaggattttgccacaattatttaaatattatgtttgtgaactatctaagcatgagaaaatacaaagctttctttgtatctggctgatactcatttggatgattctgtgactcatagaacatgatgttaaatgagaccagactcaactgccaccagtccccagctgcagaccttcatccccttcatctcccactaggggctcgtggtctggaagaaacatgtatcaagcaacacagccccttatcccagatagaaaagtgtctcaaatgcattctactgcgggacagtcagtaggatcattttcataaagcaaggacatcatatgtttctagaaattacaagcatataactttagcctacaatctcttattaaaaatttttaacaaaattgtattacaaatgcatttcatcagaactcaaatttaaatggtgtttgttttgggtttttatttataatgctgaagttattccatataagtatcaagttaaacacaattcattttgattataaactatttgactttttaaaatcttctgacacagtaaatatatatatcaagattgatgtatcaaaatttattgcacactttaaagtgtaaaatcattttttaaaatcttgaatccacaaataaagttctattctgattttaaaaaacaaaaaaaaa

SEQ ID NO: 298890 - DNA, 724 bp, Homo sapiens
ctcccgcttctcctcctcctcctccacagttgcctgccctgggcgggggcgagcgcgtccggtttgctggaagcgttcggaaatggcaacttgcgcggtggaggtgttcgggctcctggaggacgaggaaaattcacgaattgtgagagtaagagttatagccggaataggccttgccaagaaggatatattgggagctagtgatccttacgtgagagtgacgttatatgacccaatgaatggagttcttacaagtgtgcaaacaaaaaccattaaaaagagtttgaatccaaagtggaatgaagaaatattattcagaaaaataattctggaaggacctaagaaactgtttactgtatttgctctgggggtgggacaaaggttcatcctcagcagcaccggcttctttttgaagtgtttgacgaaaaccgattggtaagttatattgtgcttatatgaaatatgaagtaagggtacatttcagtggagcagccaggggaagtgggtaagcagtctgggatttgagtgatggcttgggggtggttatggagactctgggcaaaatggtgagggagatagaatttgttttcttcctcctggtcctactcgctccctttccattctcctcccaagcacctcttctgattgccaacatattataaggtcttactcaagacctcttgtgacaggagaggacagaaaaccaacctctttgtcctgcctt

SEQ ID NO: 298891 - DNA, 500 bp, Homo sapiens
ctcccgcttctcctcctcctcctccacagttgcctgccctgggcgggggcgagcgcgtccggtttgctggaagcgttcggaaatggcaacttgcgcggtggaggtgttcgggctcctggaggacgaggaaaattcacgaattgtgagagtaagagttatagccggaataggccttgccaagaaggatatattgggagctaggtaagtatatctatttggattataattttaaaactttgcatttgttaattagttttttccaaactttggttaaattagaaatcaaatagtattagtaaattgttgtggaaagtataataataatattaccagttggtggtttactaaatctcttggtatctgaattactaaatttgtgaaattaggcagaagtacaaatgatagcaatagtcacaagatacattattgagctctgcttctggaaatttgcaaaattctaacagactaatcctttagcagataacaaccataaactctgg

SEQ ID NO: 298892 - DNA, 483 bp, Homo sapiens
ttaaacagggtgcaggaccataagctttcagtaatatatttaatccagtcttactttccaggctgttgacttttttgatctcctagaattatctctatgctctaaccaagccagcctgcagacatgtgcatagtccgtgttcttttgggatgttaacatactaaccactctatactgtttttctgcttattctcttctgccctccctttggctccacaacccacctgctcagctagttttcatttgagttgtgatgtcggctgcaattcctcttgggcaggaaagtgaaagcactgtcaagttagcatttgataaactaaagctacttttttttctcacttccaacttaaattatgccttaggtgatagttcatgagtattcttgaaaagtacatgcttttggtgttatagatatattttgaaaacccactattttattctagacagaaaatccaagattggagagaccatatacatttaagg

SEQ ID NO: 298893 - DNA, 3681 bp, Homo sapiens
atggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccactgaacccggtccccggctcctcctcattctccaaggtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccggg

SEQ ID NO: 298894 - DNA, 3579 bp, Homo sapiens
atggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccactgaacccggtccccggctcctcctcattctccaaggtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccggg

SEQ ID NO: 298895 - DNA, 2453 bp, Homo sapiens
cggaaggaccgggaaggaagagcggagccggagcgagccaagcagcccacaaagtgccatgccccggcggggttgaggcgcgcggcggtcggcccggcgcgctgggaggacgcccgggagctgcgcgacgcggggcggcgcggaagggcagccccggcgggcggcggcgggcccgggctgcgaccggagcgagccccatgccccgcgcgggctgacgggccggagcccgcacggagcggccgggcgggacaggtagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccggg

SEQ ID NO: 298896 - DNA, 4043 bp, Homo sapiens
  misc_feature (3695)..(3695): n is a, c, g, or t
atggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccactgaacccggtccccggctcctcctcattctccaaggtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccgggaaaaaaaaaaaaanaaaaaaaaaaaaaaaaaagggggggcacaacaaaaaaaatatccctgaagagggggccccaaggattaaggaggaaacacaagattattatgataaaacaaggggggcccaaatataaaagaagtggaaataataagaataggaaatgaccgagataataacaaggtgtagacaattggaaaaaatgtaagtgaggaaacatttggtgaggaaaccattaattcggggggtagacactattgggacattaccaaagaaattaaaagacaacgaaatataacactgtacgtttattagtgttaacacgacaatagtacgctagaagtggtaaaggtgattagaatgtag

SEQ ID NO: 298897 - DNA, 4030 bp, Homo sapiens
  misc_feature (3695)..(3695): n is a, c, g, or t
atggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccactgaacccggtccccggctcctcctcattctccaaggtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccgggaaaaaaaaaaaaanaaaaaaaaaaaaaaccgcgcgggggccatcaagggcgggggggggaaaaaggggaagggaaggggcccggggcaaaaaggggatccggggcccaagttttcgtggccacacagggggcaaataggggggaccaccaaaaatggggagccgaaataaatggaaaaggccaggttaccggggattagacggcggaacacgaggcacacaaacgaaaacacaagcagcacgagagagcgcacgagacgacagggggatctaaccaacacaggacccaagcagaacggggagcacggaagaagggataacaccaagcgaaagaaaccacaaaacaaggc

SEQ ID NO: 298898 - DNA, 2155 bp, Homo sapiens
cgagtagtagagacatctagatgagcccctaggctgtgctagacgggagcatagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccggg

SEQ ID NO: 298899 - DNA, 2999 bp, Homo sapiens
atggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccactgaacccggtccccggctcctcctcattctccaaggtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccggg

SEQ ID NO: 298900 - DNA, 2939 bp, Homo sapiens
atggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccactgaacccggtccccggctcctcctcattctccaaggtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaacctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgctctcccgcgcccacagtaacggatgacaaatttatgcggagcaaacaaatgtggttcttgtgtcc

SEQ ID NO: 298901 - DNA, 1153 bp, Homo sapiens
cggaaggaccgggaaggaagagcggagccggagcgagccaagcagcccacaaagtgccatgccccggcggggttgaggcgcgcggcggtcggcccggcgcgctgggaggacgcccgggagctgcgcgacgcggggcggcgcggaagggcagccccggcgggcggcggcgggcccgggctgcgaccggagcgagccccatgccccgcgcgggctgacgggccggagcccgcacggagcggccgggcgggacaggtagccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccggg

SEQ ID NO: 298902 - DNA, 789 bp, Homo sapiens
aagaagaaggcctttcatgtctccaaagaaacatggtctgtattcttcctggccttgtcagaattcaccccaagatcaaatccacaaaccctggcatctttattagagatgtagcaaaaaagctgtgtgaggtgtgggataccttaaatgtcagtgaaaagcagccttgcatcactaagccagtgaagctgagggagaaatacgagaaggatgttggagaggtgaagtcggctctgtgccatcctgaaaaatcaacttagaaagataggtggacttcatcagatttgtcagtccttccttgttttaaagagaaaaatgatctctgccttgcttcagataggatatggctattttttttccttctttttctaatgtagcagtgatggaaaacaccagtctttgaagaacaaatggaggttcccagtgacatgaatccattatatttgattttggattgtattttttaacccctttttatggcatagaattctggtgccttgctccctgggtttgtctctgtgctacgagtaggctttcttcacattctggcttacaggggaacacaactattccacaagtggcctttagtgctctttataatatgatttcctgtaatttttaaactgtatgtgtaatttatattctggctctgtccaatatttgaacaactttaataggttgatttccatatatattatgcaaataattcttacctgattttttatgttctatcttaaataaatactgcaccacttattaataaatagacatttcagtgataaaaaaaag

SEQ ID NO: 298903 - DNA, 2090 bp, Homo sapiens
aaaagctacaaagaagcagacaggactcaacttaggacatcttatggttatgtaactaagagattattttaggaagtaaacaggcctctgttggctcaaatgaacatcttcattgttagtttccacttacattgttctcgggataaatcggccagaatttggcagggctccccagcagtccttgtgaatccctgtggtaggatgtttcagttctcctgagtcaggctgaagtgaaagctcctaagagatattcagaaagaaggatggtcaagttctagaacaacaatagttggcccagtaattttaaagattgtcattctacctaagccttcatcctccagatagcactgttatgggcttaaaataagcttcaagggaaataatgaatttctttgacaccgccaaaaatcggctgtatataagaataacttgagaatggcttacaatgaggtagtcaaaagcccagctcagtgctcaggaatgtatttgtaattcctcttagacttgtcgaatggactgcaatttgatacctaagagtaataaaaaatgagaccatattttatgttaatgttcccttctcttcctctgcccacaaaagtgaggtcagggaaggggagagaaacttatcctaagcactccttatgagttgcttgtgacatgatagctctctctaaagttcatgcaatcctcatcgcaaccccatgagggagatgttattgtctccatcttatagatgaggaaactgaagacaagaccttgtcaaaggtcacacattgtaagaagtagagctgcatattcaaccaaagcccgtgtacctggaaagctcattctctctcccccttcttcctctcaaatcaggccctagctcctccacaatgcttcgggcttctacgttcactcagctttacagtaaaatgatcacagacccatgagttccctggagagtagagtgatgcctgggtcagctgttcctcttgtctgttcagcaggtcctttgagtggcttcacaatccagctgtcagtggcagaaaataatgcctcataaattattcacctggttcacattggaatccattagctctcggggcttggtgtggctgcagatcatccacaagtgccccttgttctctgcccccaaggagctcctgtcattgtttttaaccaaacaagttcaaatatctccacgtctctgctgactctggtcttttgtctctagactgtacctttatttctgagctctgaaattctgcagaaacaggtgagtctataaaaacattctgtgggaggccaaaagctcagaacagttgtgtctctctttctcagtattaaaagatcaaggtttcccatggaagccaacctgatctggtaattgggcccttctatacccctctgaatacttttccaaggagggggcagttcccacccccatagttcccctgagggttaagagtccaggtggtggccaagttgcaagatttggggcagccattttgccaaggatcagagatttgctgttggagaggtgaagtcggctctgtgccatcctgaaaaatcaacttagaaagataggtggacttcatcagatttgtcagtccttccttgttttaaagagaaaaatgatctctgccttgcttcagataggatatggctattttttttccttctttttctaatgtagcagtgatggaaaacaccagtctttgaagaacaaatggaggttcccagtgacatgaatccattatatttgattttggattgtattttttaacccctttttatggcatagaattctggtgccttgctccctgggtttgtctctgtgctacgagtaggctttcttcacattctggcttacaggggaacacaactattccacaagtggcctttagtgctctttataatatgatttcctgtaatttttaaactgtatgtgtaatttatattctggctctgtccaatatttgaacaactttaataggttgatttccatatatattatgcaaataattcttacctgattttttatgttctatcttaaataaatactgcaccacttattaataaatagacatttcagtgataaaaaaaag

SEQ ID NO: 298904 - DNA, 1193 bp, Homo sapiens
tcgagctccgtacccccccgactagcccgacagtccccgactagcccgaccgtccccgactagcccgacagccccgactagcccgacagcaggtcctttgagtggcttcacaatccagctgtcagtggcagaaaataatgcctcataaattattcacctggttcacattggaatccattagctctcggggcttggtgtggctgcagatcatccacaagtgccccttgttctctgcccccaaggagctcctgtcattgtttttaaccaaacaagttcaaatatctccacgtctctgctgactctggtcttttgtctctagactgtacctttatttctgagctctgaaattctgcagaaacaggtgagtctataaaaacattctgtgggaggccaaaagctcagaacagttgtgtctctctttctcagtattaaaagatcaaggtttcccatggaagccaacctgatctggtaattgggcccttctatacccctctgaatacttttccaaggagggggcagttcccacccccatagttcccctgagggttaagagtccaggtggtggccaagttgcaagatttggggcagccattttgccaaggatcagagatttgctgttggagaggtgaagtcggctctgtgccatcctgaaaaatcaacttagaaagataggtggacttcatcagatttgtcagtccttccttgttttaaagagaaaaatgatctctgccttgcttcagataggatatggctattttttttccttctttttctaatgtagcagtgatggaaaacaccagtctttgaagaacaaatggaggttcccagtgacatgaatccattatatttgattttggattgtattttttaacccctttttatggcatagaattctggtgccttgctccctgggtttgtctctgtgctacgagtaggctttcttcacattctggcttacaggggaacacaactattccacaagtggcctttagtgctctttataatatgatttcctgtaatttttaaactgtatgtgtaatttatattctggctctgtccaatatttgaacaactttaataggttgatttccatatatattatgcaaataattcttacctgattttttatgttctatcttaaataaatactgcaccacttattaataaatagacatttcagtgataaaaaaaag

SEQ ID NO: 298905 - DNA, 1536 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggaga

SEQ ID NO: 298906 - DNA, 949 bp, Homo sapiens
  misc_feature (905)..(905): n is a, c, g, or t
  misc_feature (917)..(917): n is a, c, g, or t
ccagggagggggtggaaaggagggagaaaaggcagaggcgtcaagggaggccggagggagagtggggtggacagaggagcggagggacgagagggaagcgcacgatagctgcgcggagagagagcgaagagcaggaggaggaacaaaggcgacccaagacacccagagagggacagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgtatggaagcccctgnaaagcgagattntaggattcttataagcttattaagctctgcag

SEQ ID NO: 298907 - DNA, 841 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggattatgttcctgaggtctcagcttggatcaggagattatgaagtaagatcctgaacttaggaaatgctgagcttttggattcggagtctgtcaacttcaggtatcagctaaagtgggatgaa

SEQ ID NO: 298908 - DNA, 1141 bp, Homo sapiens
attgaagtttgttttcctctttgatcctaccactttttttttctgttatactattggatttttctatttcttttaaattaagattttctgagatggacagaacactttgtattgggaactaatatttttgatatagttttgtttataatttaaaggaaatgcctacattgtcttaccttgaatgtcatatagaattgcagaatcatatatatctctcatgttctttatattgttaatcacttttaaagtaagaaataaatgaaacacctacattcttcattgtatagccctgtctattaaaaaggttctagggcttctatagattcttactttgcctatatagactaacatggatctaactttttgactatcttcctctttttattttcttatttattcttgacattttatgagtgggtatatattttcattttgtggcagcctgataatttgttattaactatttgagttgtttctaatgtccttgttataaatgccatagcagttaataactacacatatgtagcttttaaaaatttttttcagaggtattcttcaccatgagatgactaaaaaaattttgattaattctatgacttttaaaatatgttgcttgattttctttcccctgaaagattgtgttagtttgtaacacactctcacagtaccactgtaaaataagtttattgttttgtaataattttgataatttctttctttaatttggaatatgcttctaacttttttaccctcttttaggtgatgaaggggataacttctatgtgattgatcaaggagagacggatgtaagatttaccaatatcaaaaatatgttgatcttaaaagccaatgtattgatcgcttccgagcaataagaatagtgattttgaagggtcattacatcccttgtatgtcagattttattaataccttttgccaagtatttttatgacacagagaaactctttaaaggtaattttctgttcagaactttgctggagtggtggtgaagaagtgtgtgtagctgggtgcagtggccgatgcctataatcccagcactttgggagatggaggcaagagggttgcttgagcccaggagttcaagaccagcctgggcaacaaagtgaaacctcatctctta

SEQ ID NO: 298909 - DNA, 979 bp, Homo sapiens
ttatcgactctcactgttgcctacagagcacagatcctgaactaaatgaaacatttacttggaataatgctaattctgtacatattttattccctagtccccacttccctgtttaaaaacaaaatctacttagaaaaaaatccctgtgaatcagttgtctaatgaatttagcaagttaaatgccagattgacattttgctttatagtttatacaagcatgtgtgtgtttttttctcgcagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggtaaaaataaatgtggggagatgatgaggtgattgtgacagttgttacatttaataactggaatgttactaatttgtattttttggaagaaaaggaatctgactaaataaaaagtctaaaacaatttcaaataagaaatacagttaaggcatttgtagtaatttaaaaattcttaattagtagaatttatcagaaaaatgaacctgtatgctaactgtacttggctaataaagggtttccaaacaattctttgtaactttttaaattagtgcgtagaactataacagataaaactgatcagaactagtatagcagttctatgaataagaaattctatagttcttaaaggcagttaatgctcctcccgtttggaacaaagcaagtaagcgtagtaaatcttatcccacttttaaaactagtgtaatgaaacatgaatctagcttgtgactgatatatcagaaattttcaattagattcggtctattttagtatagagtatatctgataaattactgtagagatattgatattgatgttcctcaaaaattttactcca

SEQ ID NO: 298910 - DNA, 1031 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagttgacttttgtgccctggtaattctgtatcctgtttaccgtttacctacttcccacgtcatcatgatttcttttgagggagaactgaatgaaattcccttaagggcctgacttcagcacccgtctctgcagagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatattttgatgcatgtatcggtctcctttattgacgggagatgtggttccgcagtgattaagggatacttttgtgatgagtcaggcaagacggatgttatggtcacatgatgggcaccggtcgggacgaggggctggacaaaggttagatggcacggggacgacgttagaaaaatggattgggttacgacatataagttctggacggagagagaactacaaccatacgcgcgaataagcacacataaggaaggcaagaaaaagcaaaaggtagaagaaatagta

SEQ ID NO: 298911 - DNA, 626 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagttgacttttgtgccctggtaattctgtatcctgtttaccgtttacctacttcccacgtcatcatgatttcttttgagggagaactgaatgaaattcccttaagggcctgacttcagcacccgtctctgcagagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaagatgagatttctcctcctccacccaacccagtggttaaaggtaggaggcgacgaggtgctatcagcgctgaggtctacacggaggaagatgcggcatcctatgttagaaaggttataccacaagattacacgactggccgctgtg

SEQ ID NO: 298912 - DNA, 325 bp, Homo sapiens
  misc_feature (304)..(304): n is a, c, g, or t
  misc_feature (307)..(307): n is a, c, g, or t
tccttgtaatccaagcagtcgaggaacagtttctcaaagtgtttttatttatttcccagaatgtaatcctttcgaaacaattttgtcacaactgaattttcaaaagaatgaatctgagtgttttgttttacatagagacaatgcagcgaaagttttaaagcagttaaataattgtgtgtggggagggaaggctaggttgttgggctttacaaataagtacacatagagaatccgggtaactcgattaaaaatattaagactgtgaagtctggttattcagggatttacatggtgactgcttgantanaaggagggatcctctaga

SEQ ID NO: 298913 - DNA, 307 bp, Homo sapiens
  misc_feature (50)..(50): n is a, c, g, or t
ttcacacgtatttcaagcaagattaatgaaggggggggcctgtgggtaanctctaaaggatttacattcccctgggctaaggcactggggccgaactctaggagaccctaacctgtgggctgcagatcctttgggggccagaaacccaaactcacaccaagctctgtctaaggactcaatacatattatttcactcatctctatgtttcacaaaattttcaaggcatgtagttgctgttgttatgaataaaatataaattaatgtaaacatgataaaaaaaagaaaaatggcctcatttggcctcaa

SEQ ID NO: 298914 - DNA, 138 bp, Homo sapiens
gcggccgcctactactactactactgctcgaattcaagcttctaacgatgtacggggacatgtgtgctaatatactttttttgttatagattgtcttaatggtaggtcaagtaataaaaagagatgaaataatttaaa

SEQ ID NO: 298915 - DNA, 3631 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298916 - DNA, 3797 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaaaaaaaaaaaaaaaaaaactcgagactagtttttttttttttttacgtggtcacaggtttattctgagttttaatttattatacaaaagtaaaggttttaatttaatattaatagtagaaaaacactttcttacgtgtgccatatggaaagataaaggatctattct

SEQ ID NO: 298917 - DNA, 3641 bp, Homo sapiens
ccagggagggggtggaaaggagggagaaaaggcagaggcgtcaagggaggccggagggagagtggggtggacagaggagcggagggacgagagggaagcgcacgatagctgcgcggagagagagcgaagagcaggaggaggaacaaaggcgacccaagacacccagagagggacagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298918 - DNA, 3662 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccaggtgagtggggtcggccgggggctcaggcgagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298919 - DNA, 3696 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccaggacaacggctctattttactggggtccgccatcgtctcgtccgccggtcctggctcttcttgtaaagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298920 - DNA, 3829 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccaggacaacggctctattttactggggtccgccatcgtctcgtccgccggtcctggctcttcttgtaattgacttttgtgccctggtaattctgtatcctgtttaccgtttacctacttcccacgtcatcatgatttcttttgagggagaactgaatgaaattcccttaagggcctgacttcagcacccgtctctgcagagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298921 - DNA, 3774 bp, Homo sapiens
ccagggagggggtggaaaggagggagaaaaggcagaggcgtcaagggaggccggagggagagtggggtggacagaggagcggagggacgagagggaagcgcacgatagctgcgcggagagagagcgaagagcaggaggaggaacaaaggcgacccaagacacccagagagggacagttgacttttgtgccctggtaattctgtatcctgtttaccgtttacctacttcccacgtcatcatgatttcttttgagggagaactgaatgaaattcccttaagggcctgacttcagcacccgtctctgcagagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298922 - DNA, 3906 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtatgtatgaattccctcacaataaatacatggtttctttaagtcacctctcagtgagatattgtagtcttccataattttgtcttctcctgaattttattttctaactgcagtcttttttggctctgagagggaaggtgtgagattttgatctttactcatttaatgaaattactgattgtctcatatctattgtcttctttctcagaagtgcactgctttaaggaaatgtttttcatagaagttagcctgttacccatctttgctttctccaggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298923 - DNA, 3585 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccatgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298924 - DNA, 3325 bp, Homo sapiens
ccagcactttgggaggccaaggtgggtggatcatttcagcccaggagtttgagatcaccctgcgcaatgtggcaaaaccctgtctctacaaaaactacaaaagttagctgggcgtgggggtgcgtgcctgtggtcccagccacgtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298925 - DNA, 3720 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagttggtataaattaacctagccactgggctaccgaagtaaggatctaagggctatctgcaggcagtatgagaatcctgctcagactagagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298926 - DNA, 3077 bp, Homo sapiens
tgttctagaggatcacatggaagaatgtgcgtttcacatctgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298927 - DNA, 3468 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298928 - DNA, 3716 bp, Homo sapiens
attgaagtttgttttcctctttgatcctaccactttttttttctgttatactattggatttttctatttcttttaaattaagattttctgagatggacagaacactttgtattgggaactaatatttttgatatagttttgtttataatttaaaggaaatgcctacattgtcttaccttgaatgtcatatagaattgcagaatcatatatatctctcatgttctttatattgttaatcacttttaaagtaagaaataaatgaaacacctacattcttcattgtatagccctgtctattaaaaaggttctagggcttctatagattcttactttgcctatatagactaacatggatctaactttttgactatcttcctctttttattttcttatttattcttgacattttatgagtgggtatatattttcattttgtggcagcctgataatttgttattaactatttgagttgtttctaatgtccttgttataaatgccatagcagttaataactacacatatgtagcttttaaaaatttttttcagaggtattcttcaccatgagatgactaaaaaaattttgattaattctatgacttttaaaatatgttgcttgattttctttcccctgaaagattgtgttagtttgtaacacactctcacagtaccactgtaaaataagtttattgttttgtaataattttgataatttctttctttaatttggaatatgcttctaacttttttaccctcttttaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298929 - DNA, 3077 bp, Homo sapiens
ctcgtcagaaatcacctattcttctctgttgtgtactgcaaacataatatattctgttttttaaaacaaagttcaggattgtgaccttttaaaaaggtttgagggtttttaacatttaagtgtttgtatctagaaaataaacttttttgatgtcacttgcactttaggtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298930 - DNA, 2827 bp, Homo sapiens
accgaacactatgacatgttcgattcgagctcgtaccctacggatctagcgagagacacctatagagaatcctcatggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298931 - DNA, 2822 bp, Homo sapiens
  misc_feature (2719)..(2719): n is a, c, g, or t
  misc_feature (2727)..(2727): n is a, c, g, or t
  misc_feature (2769)..(2769): n is a, c, g, or t
  misc_feature (2795)..(2795): n is a, c, g, or t
  misc_feature (2812)..(2812): n is a, c, g, or t
  misc_feature (2820)..(2820): n is a, c, g, or t
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttagtttcttgtnaatggtanggcccctttttatttttccattggggaattttaatatttttnaaggggaaatggtaggggggtttttnttttttggggaagtggnacttggcnaa

SEQ ID NO: 298932 - DNA, 2792 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttgtgcctacattacagaactgtgaaattttgtttaaaaaaataataaaaataaactgttgggtatcattggaataatggtcgacg

SEQ ID NO: 298933 - DNA, 2807 bp, Homo sapiens
ggcactagcaggacaggtcagaagaatttccaaattccgttcaaaaggttatataaccatggggtgagcgtaaggtaggcgaaagagacgctactcacccagagaggcctgttaatgtaatccatgctgtttatatgaggatctggtatattttgacatcctgcttatctcctcgaggagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298934 - DNA, 2673 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccaacccagagtgtcgggatacccgacggctcgaat

SEQ ID NO: 298935 - DNA, 2966 bp, Homo sapiens
atcccccgggctgcagaattcggcacgaggtctcctttattgaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298936 - DNA, 2554 bp, Homo sapiens
taacgtcggggcattccggataggctgagaaagtgttgtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatcccagcacctattgaattaccatagagtaatgatgtaacagtgcaagattttttttttaagtgacataattgtccagttataagcgtatttagactgtggccatatatgctgtatttctttgtagaataaatggtttctcattaaactctaaagattagggaaaatggatatagaaaatcttagtatagtagaaagacatctgcctgtaattaaactagtttaagggtggaaaaatgcccatttttgctaattatcaatgggatatgattggttcagtttttttttttccagagttgttgtttgccaagctaatctgcctggttttatttatatcttgttattaatgtttcttctccaattctgaaatacttttgagtatggctatctatacctgccttttaagtttgaaactaactcatagattgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298937 - DNA, 1539 bp, Homo sapiens
tgagcggacctctcctacgtatctatcaacaacgtataagagtctcttttttctgcctgctcactagcattgttattgcctgtatttttgataaaagccattttaactgggatgaaatatttcattatactttcgattagtatttatctgattagtgatgttgaccatttttttcatatacctgttgaccatttacccaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttccttcctttttattcagctagaatttctggtgggttgatggtagggtataatgtgtctgtgttgcttcaaattggtctgaaaggctatcctgctgaaagtcctgctttcctatctagcatttatttctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298938 - DNA, 1280 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggacttgccatatgcaaagggtaccgagctc

SEQ ID NO: 298939 - DNA, 1811 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtatgtatgaattccctcacaataaatacatggtttctttaagtcacctctcagtgagatattgtagtcttccataattttgtcttctcctgaattttattttctaactgcagtcttttttggctctgagagggaaggtgtgagattttgatctttactcatttaatgaaattactgattgtctcatatctattgtcttctttctcagaagtgcactgctttaaggaaatgtttttcatagaagttagcctgttacccatctttgctttctccaggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggaga

SEQ ID NO: 298940 - DNA, 1378 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtcacctcatcatctcaaggaggagcattcccctgggctaaggcactggggccgaactctaggagaccctaacctgtgggctgcagatcctttgggggccagaaacccaaactcacaccaagctctgtctaaggactcaatacatattatttcactcatctctatgtttcacaaaattttcaaggcatgtagttgctgttgttatgaataaaatataaattaatgtaaacatg

SEQ ID NO: 298941 - DNA, 1440 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaatgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggaga

SEQ ID NO: 298942 - DNA, 1052 bp, Homo sapiens
gcagctaagcgataatttcaaagaagcaacagctaaatttacactggtctttcaaaagtaagagcctataaatgactgggtctcttcaaatagctgtatctaggctgggcacgctggctcacacctgtaatcctggcattttagaaggtctaaatgcaatcatgattgcatttagacaaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298943 - DNA, 916 bp, Homo sapiens
gacggtttatcgtggtcattcgcacaccttctattaggtacagcacggggtgctataggggccgtgagcagcgcatcctcgtttccagtctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattacgttcttacaagcttaaagcttgatttgatctttgtttaaatgccaaaatgtacttaaatgagttacttagaatgccataaaattgcagtttcatgtatgtatataatcatgctcatgtatatttagttacgtataatgctttctgagtgagttttactcttaaatcatttggttaaatcatttggcttgctgtttactcccttctgtagtttttaattaaaaactttaaagataagtctacattaaacaatgatcacatctaaagctttatctttgtgtaatctaagtatatgtgagaaatcagaattggcataatttgtcttagttgatattcaaggctttaaaagtcattattcctgggcttggtaagtgaatttatgagatttactgctctagaaagtatagatggcgaaaggaccgttttgtattgcttcctgattaccagtctgattataccatgtgtgctaatatactttttttgttatagattgtcttaatggtaggtcaagtaataaaaagagatgaaataatttaaa

SEQ ID NO: 298944 - DNA, 999 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactatagaaaaaattagctgggcatggtggcacacgcctataatcccagcactttgggaggctgaggtgggcggatcacctgaggtcgagagttcgagaccagcctggccaacacggtgaaaccccgtctctactaaaaatgcaaaaattagctgggcatggtggcacaaatgggacacgaatgttca

SEQ ID NO: 298945 - DNA, 1056 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtaagatttaccaatatcaaaaatatgttgatcttaaaagccaatgtattgatcgcttccgagcaataagaatagtgattttgaagggtcattacatcccttgtatgtcagattttattaataccttttgccaagtatttttatgacacagagaaactctttaaaggtaattttctgttcagaactttgctggagtggtggtgaagaagtgtgtgtagctgggtgcagtggccgatgcctataatcccagcactttgggagatggaggcaagagggttgcttgagcccaggagttcaagaccagcctgggcaacaaagtgaaacctcatctctta

SEQ ID NO: 298946 - DNA, 655 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccattgggccgcgggggttcgcctcgact

SEQ ID NO: 298947 - DNA, 594 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttatacccaaagattacagacatgccgcttagccaaccaccgtgactagtggggtcctctagagtcaccgcgc

SEQ ID NO: 298948 - DNA, 759 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaacaccaggagactatcactcatgaagttgtaacacagatcggccagatctaagcttgtaagattgtagtgagaatgtagaggatgactacccgtggattccaacagtctttggatggcacatattcacatgaggagatgaaattgtaaggcatttagcggatgttaagagccatcacgggtaactcgtccgttgattgtacaggacagacaacgtggttttagtgaca

SEQ ID NO: 298949 - DNA, 905 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggtaaaaataaatgtggggagatgatgaggtgattgtgacagttgttacatttaataactggaatgttactaatttgtattttttggaagaaaaggaatctgactaaataaaaagtctaaaacaatttcaaataagaaatacagttaaggcatttgtagtaatttaaaaattcttaattagtagaatttatcagaaaaatgaacctgtatgctaactgtacttggctaataaagggtttccaaacaattctttgtaactttttaaattagtgcgtagaactataacagataaaactgatcagaactagtatagcagttctatgaataagaaattctatagttcttaaaggcagttaatgctcctcccgtttggaacaaagcaagtaagcgtagtaaatcttatcccacttttaaaactagtgtaatgaaacatgaatctagcttgtgactgatatatcagaaattttcaattagattcggtctattttagtatagagtatatctgataaattactgtagagatattgatattgatgttcctcaaaaattttactcca

SEQ ID NO: 298950 - DNA, 625 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaagtgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggaga

SEQ ID NO: 298951 - DNA, 853 bp, Homo sapiens
acgtcagtagccgaacgctgattggctgcggccaggccgtttccggtggagctgtcgcctagccgctatcgcagagtggagcggggctgggagcaaagcgctgagggagctcggtacgccgccgcctcgcacccgcagcctcgcgcccgccgccgcccgtccccaggacaacggctctattttactggggtccgccatcgtctcgtccgccggtcctggctcttcttgtaattgacttttgtgccctggtaattctgtatcctgtttaccgtttacctacttcccacgtcatcatgatttcttttgagggagaactgaatgaaattcccttaagggcctgacttcagcacccgtctctgcagagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccattgggccgcgggggttcgcctcgact

SEQ ID NO: 298952 - DNA, 1152 bp, Homo sapiens
ccgccttcgcccccgcgcgccgcggcctcttcgctcaccctcccccatttcctgaaggacaacggctctattttactggggtccgccatcgtctcgtccgccggtcctggctcttcttgtaagccggtagttttcctctccacttttgacgactcgtcattgctagcagtagcctttcctcttcatagcggagtgatctttcccccaacacgacggtcttagtcgggctcctgaatttcctcttgtcccctttcacctctctccctttcccaattttgcccccctgaggcctcctcgccaccactgtggccttccgactggcgtagcttgaagtctcggcttcccttcattttgtggtcatgaccgtggcctacgtgaagtgaagggcattttcctgcccttcttctagcctactccttgagagattcccaagagatccgtctttttagcagagcgaggaaagcaaacacttactcaagatgaccctaggggagccgtaacttggctggtctaagggggtgcggtctgaatcaggaacagtttctcaaagtgtttttatttatttcccagaatgtaatcctttcgaaacaattttgtcacaactgaattttcaaaagaatgaatctgagtgttttgttttacatagagacaatgcagcgaaagttttaaagcagttaaataattgtgtgtggggagggaaggctaggttgttgggctttacaaataagtacacatagagaatccgggtaactcgattaaaaatattaagactgtgaagtctggttattcagggatttacatggtgactgcattaattttggtacatttctgttcgtatactgtcttattaccggtggctatctttttggttttcgtaatacattagttgtttcaaacaaaaacacagtttcactccttaggcccagttctctcatctctaccagccaaagacctgatcttagaatgattgatcatttgaatgttcttaaaatatgacaatgctttgaagcatgaaagatctgatttatgattgttcttggtggcctttaagtattatttgaaatgcagacaattctactgaagtggatcttcagttcatatgattgcctgacctggagaagtggcttgtataaatctatcctaaagtaaatg

SEQ ID NO: 298953 - DNA, 455 bp, Homo sapiens
gcgtagcttgaagtctcggcttcccttcattttgtggtcatgaccgtggcctacgtgaagtgaagggcattttcctgcccttcttctagaaaatacacggtacctattaacctcttcagctcagagcctgtggtgacgaccgtcctactccttgagagattcccaagagatccgtctttttagcagagcgaggaaagcaaacacttactcaagatgaccctaggggagccgtaacttggctggtctaagggggtgcggtctgaatcaggaacagtttctcaaagtgtttttatttatttcccagaatgtaatcctttcgaaacaattttgtcacaactgaattttcaaaagaatgaatctgagtgttttgttttacatagagacaatgcagcgaaagttttaaagcagttaaataattgtgtgtggggagggaaggctaggttgttgggctttac

SEQ ID NO: 298954 - DNA, 330 bp, Homo sapiens
caaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggtagttttgatatttgaatatcggggggatgcttttgggacccacttggtggtcatctagtctcctttgatgaatgaatcataaaatacaaaacagggtggaacttcatccatcctgtacaattcttgggtactggaaaacaggtttctgtaatagcatgctgtca

SEQ ID NO: 298955 - DNA, 309 bp, Homo sapiens
ctggaagaagcacattctggaggaaagcatgacttgggtaacgtggcccctcttggggcgattttcttttctgcaggtcacctcatcatctcaaggaggagcattcccctgggctaaggcactggggccgaactctaggagaccctaacctgtgggctgcagatcctttgggggccagaaacccaaactcacaccaagctctgtctaaggactcaatacatattatttcactcatctctatgtttcacaaaattttcaaggcatgtagttgctgttgttatgaataaaatataaattaatgtaaacatg

SEQ ID NO: 298956 - DNA, 3001 bp, Homo sapiens
gcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgcttgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggatgtgcgggacgagtgcagcaagtacgggcttgtcaagtccatcgagatcccccggcctgtggacggcgtcgaggtgcccggctgcggaaagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttggggggttggggggttagggcagggaggggactggggaagtgcgcacacagcccacacagacaacacgcacccacacagacacagagggaaggggttgggatggggacagggtgcacagcagggcggggtaggaccccagcccctcccaaaacagcctctcctactcccatagacccctttcttctccccttccccacggtaggaacatagcgtgtttatattttatggccaaactattttgaattttgttgtccggccctcagtgccctgccctctcccttaccaggaccacagctctgttccttcggcctctggtcctctctggtcccctcctgggtttcttacgtagttgatttttcctctttagtctcccccgacctgcgcccagccccgtggcccctgcccctctcctactctctgtggcagtttcatatttgctaagacgaatttgctcattaaacattttgttgtattttacttta

SEQ ID NO: 298957 - DNA, 2699 bp, Homo sapiens
gcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcatagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgcttgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggatgtgcgggacgagtgcagcaagtacgggcttgtcaagtccatcgagatcccccggcctgtggacggcgtcgaggtgcccggctgcggaaagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttggggggttggggggttagggcagggaggggactggggaagtgcgcacacagcccacacagacaacacgcacccacacagacacagagggaaggggttgggatggggacagggtgcacagcagggcggggtaggaccccagcccctcccaaaacagcctctcctactcccatagacccctttcttctccccttccccacggtaggaacatagcgtgtttatattttatggccaaactattttgaattttgttgtccggccctcagtgccctgccctctcccttaccaggaccacagctctgttccttcggcctctggtcctctctggtcccctcctgggtttcttacgtagttgatttttcctctttagtctcccccgacctgcgcccagccccgtggcccctgcccctctcctactctctgtggcagtttcatatttgctaagacgaatttgctcattaaacattttgttgtattttacttta

SEQ ID NO: 298958 - DNA, 3093 bp, Homo sapiens
  misc_feature (3013)..(3013): n is a, c, g, or t
  misc_feature (3071)..(3073): n is a, c, g, or t
  misc_feature (3078)..(3078): n is a, c, g, or t
  misc_feature (3081)..(3081): n is a, c, g, or t
gcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgcttgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggatgtgcgggacgagtgcagcaagtacgggcttgtcaagtccatcgagatcccccggcctgtggacggcgtcgaggtgcccggctgcggaaagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttggggggttggggggttagggcagggaggggactggggaagtgcgcacacagcccacacagacaacacgcacccacacagacacagagggaaggggttgggatggggacagggtgcacagcagggcggggtaggaccccagcccctcccaaaacagcctctcctactcccatagacccctttcttctccccttccccacggtaggaacatagcgtgtttatattttatggccaaactattttgaattttgttgtccggccctcagtgccctgccctctcccttaccaggaccacagctctgttccttcggcctctggtcctctctggtcccctcctgggtttcttacgtagttgatttttcctctttagtctcccccgacctgcgcccagccccgtggcccctgcccctctcctactctctgtggcagtttcatatttgctaagacgaatttgctcattaaacattttgttgtattttactttaaaaaaaaaaaanaaaaaaaaaaaaaaaaaaaaaaaaaaaaaaaaaaaaaaaaaaaaaaaggggggggggnnnaaaanttnccccgggggggc

SEQ ID NO: 298959 - DNA, 2867 bp, Homo sapiens
gcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgcttgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggatgtgcgggacgagtgcagcaagtacgggcttgtcaagtccatcgagatcccccggcctgtggacggcgtcgaggtgcccggctgcggaaagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttggggggttggggggttagggcagggaggggactggggaagtgcgcacacagcccacacagacaacacgcacccacacagacacagagggaaggggttgggatggggacagggtgcacagcagggcggggtaggaccccagcccctcccaaaacagcctctcctactcccatagacccctttcttctccccttccccacggtaggaacatagcgtgtttatattttatggccaaactattttgaattttgttgtccggccctcagtgctgcccctctcctactctctgtggcagtttcatatttgctaagacgaatttgctcattaaacattttgttgtattttacttta

SEQ ID NO: 298960 - DNA, 2935 bp, Homo sapiens
  misc_feature (2913)..(2915): n is a, c, g, or t
  misc_feature (2920)..(2920): n is a, c, g, or t
  misc_feature (2923)..(2923): n is a, c, g, or t
gcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgcttgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggatgtgcgggacgagtgcagcaagtacgggcttgtcaagtccatcgagatcccccggcctgtggacggcgtcgaggtgcccggctgcggaaagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttggggggttggggggttagggcagggaggggactggggaagtgcgcacacagcccacacagacaacacgcacccacacagacacagagggaaggggttgggatggggacagggtgcacagcagggcggggtaggaccccagcccctcccaaaacagcctctcctactcccatagacccctttcttctccccttccccacggtaggaacatagcgtgtttatattttatggccaaactattttgaattttgttgtccggccctcagtgctgcccctctcctactctctgtggcagtttcatatttgctaagacgaatttgctcattaaacattttgttgtattttactttaaaaaaaaaaaaaaaaaaaaaaaaaaaaaaaaaaaaggggggggggnnnaaaanttnccccgggggggc

SEQ ID NO: 298961 - DNA, 2464 bp, Homo sapiens
gcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgcttgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggatgtgcgggacgagtgcagcaagtacgggcttgtcaagtccatcgagatcccccggcctgtggacggcgtcgaggtgcccggctgcggaaagatctttgtggagttcacctctgtgtttgaccctgccctctcccttaccaggaccacagctctgttccttcggcctctggtcctctctggtcccctcctgggtttcttacgtagttgatttttcctctttagtctcccccgacctgcgcccagccccgtggcccctgcccctctcctactctctgtggcagtttcatatttgctaagacgaatttgctcattaaacattttgttgtattttacttta

SEQ ID NO: 298962 - DNA, 2330 bp, Homo sapiens
gcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgcttgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggatgtgcgggacgagtgcagcaagtacgggcttgtcaagtccatcgagatcccccggcctgtggacggcgtcgaggtgcccggctgcggaaagatctttgtggagttcacctctgtgtttgactgcccctctcctactctctgtggcagtttcatatttgctaagacgaatttgctcattaaacattttgttgtattttacttta

SEQ ID NO: 298963 - DNA, 2219 bp, Homo sapiens
gcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgcttgagcaccatcaatcagacgcctgtgacccaacaagcgcctggccaggcgcttgttgggaagatgtctgctttctcctgcacttgaaggcaggcaatctctcagagttagggaaaacaggcaagaagtcagagagaaacggaggcacctggggaaagcggatggaagatggcctgggagcagtgagagccaagagcaggcagggccttcctcagggaagactgagggcccttcacacactcaccgcagcttc

SEQ ID NO: 298964 - DNA, 1919 bp, Homo sapiens
  misc_feature (1685)..(1685): n is a, c, g, or t
  misc_feature (1687)..(1687): n is a, c, g, or t
  misc_feature (1691)..(1691): n is a, c, g, or t
  misc_feature (1705)..(1706): n is a, c, g, or t
  misc_feature (1711)..(1711): n is a, c, g, or t
  misc_feature (1714)..(1714): n is a, c, g, or t
  misc_feature (1722)..(1722): n is a, c, g, or t
  misc_feature (1729)..(1729): n is a, c, g, or t
  misc_feature (1737)..(1738): n is a, c, g, or t
gcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctgggttggncnctgnggtcccgatctgcnncaagngtnctcggggngttccanactggacnngacccggtcaaaggggtggcatcctgggaccagaggtcaacgggcagaaggcacggggaccaagggggcgcatggggagagggacatacagggacagccaggggtagagaaatggcacaacgggcagaggagaggcaaacgagacaacaacacgacggggaaccacagacacgacaaggag

SEQ ID NO: 298965 - DNA, 3062 bp, Homo sapiens
gcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggtgaaatattgtggggctgagatccctcgtagcaacaaaaagtttgctaccatcgtcgaaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgcttgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggatgtgcgggacgagtgcagcaagtacgggcttgtcaagtccatcgagatcccccggcctgtggacggcgtcgaggtgcccggctgcggaaagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttggggggttggggggttagggcagggaggggactggggaagtgcgcacacagcccacacagacaacacgcacccacacagacacagagggaaggggttgggatggggacagggtgcacagcagggcggggtaggaccccagcccctcccaaaacagcctctcctactcccatagacccctttcttctccccttccccacggtaggaacatagcgtgtttatattttatggccaaactattttgaattttgttgtccggccctcagtgccctgccctctcccttaccaggaccacagctctgttccttcggcctctggtcctctctggtcccctcctgggtttcttacgtagttgatttttcctctttagtctcccccgacctgcgcccagccccgtggcccctgcccctctcctactctctgtggcagtttcatatttgctaagacgaatttgctcattaaacattttgttgtattttacttta

SEQ ID NO: 298966 - DNA, 3121 bp, Homo sapiens
gcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagcctctagccctgcccctctcagggacgaccctggggtcaggcccctcagccctcgagggggaccaggagccagcctcctctgtcttctctggctccccagctcctcctgagcatcctcagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgcttgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggatgtgcgggacgagtgcagcaagtacgggcttgtcaagtccatcgagatcccccggcctgtggacggcgtcgaggtgcccggctgcggaaagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttggggggttggggggttagggcagggaggggactggggaagtgcgcacacagcccacacagacaacacgcacccacacagacacagagggaaggggttgggatggggacagggtgcacagcagggcggggtaggaccccagcccctcccaaaacagcctctcctactcccatagacccctttcttctccccttccccacggtaggaacatagcgtgtttatattttatggccaaactattttgaattttgttgtccggccctcagtgccctgccctctcccttaccaggaccacagctctgttccttcggcctctggtcctctctggtcccctcctgggtttcttacgtagttgatttttcctctttagtctcccccgacctgcgcccagccccgtggcccctgcccctctcctactctctgtggcagtttcatatttgctaagacgaatttgctcattaaacattttgttgtattttacttta

SEQ ID NO: 298967 - DNA, 3182 bp, Homo sapiens
gcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagcctctagccctgcccctctcagggacgaccctggggtcaggcccctcagccctcgagggggaccaggagccagcctcctctgtcttctctggctccccagctcctcctgagcatcctcagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggtgaaatattgtggggctgagatccctcgtagcaacaaaaagtttgctaccatcgtcgaaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgcttgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggatgtgcgggacgagtgcagcaagtacgggcttgtcaagtccatcgagatcccccggcctgtggacggcgtcgaggtgcccggctgcggaaagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttggggggttggggggttagggcagggaggggactggggaagtgcgcacacagcccacacagacaacacgcacccacacagacacagagggaaggggttgggatggggacagggtgcacagcagggcggggtaggaccccagcccctcccaaaacagcctctcctactcccatagacccctttcttctccccttccccacggtaggaacatagcgtgtttatattttatggccaaactattttgaattttgttgtccggccctcagtgccctgccctctcccttaccaggaccacagctctgttccttcggcctctggtcctctctggtcccctcctgggtttcttacgtagttgatttttcctctttagtctcccccgacctgcgcccagccccgtggcccctgcccctctcctactctctgtggcagtttcatatttgctaagacgaatttgctcattaaacattttgttgtattttacttta

SEQ ID NO: 298968 - DNA, 1768 bp, Homo sapiens
gcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggaggccatgatggatttcttcaacgcccagatgcgcctgggggggctgacccaggcccctggcaacccagtgttggctgtgcagattaaccagcctctcctactcccatagacccctttcttctccccttccccacggtaggaacatagcgtgtttatattttatggccaaactattttgaattttgttgtccggccctcagtgccctgccctctcccttaccaggaccacagctctgttccttcggcctctggtcctctctgctgcccctctcctactctctgtggcagtttcatatttgctaagacgaatttgctcattaaacattttgttgtattttacttta

SEQ ID NO: 298969 - DNA, 2116 bp, Homo sapiens
gcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggtgaaatattgtggggctgagatccctcgtagcaacaaaaagtttgctaccatcgtcgaaggaggccatgatggatttcttcaacgcccagatgcgcctgggggggctgacccaggcccctggcaacccagtgttggctgtgcagattaaccaggacaagaattttgcctttttggagttccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggtgagtccccggtcgctggccgctgccgcgtctgtccttccctgccctgcgctgttgccaagccatggtctcccctcctcaggggacggggcgggaggcggccaacctgaggcagtgccctgcgtgtgggctcgtccctgtcccatggtgttggctttttccaggctcttaatc

SEQ ID NO: 298970 - DNA, 1599 bp, Homo sapiens
gcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaagagcgggacaaggagaaccggcatcggaagcgcagccacagccgctctcggagccgggaccgcaaacgccggagccggagccgcgaccggcgcaaccgggaccagcggagcgcctcccgggacaggcgacgacgcagcaaacctttgaccagaggcgctaaagaggagcacggtggactgattcgttccccccgccacgagaagaagaagaaggtccgtaaatactgggacgtgccacccccaggctttgagcacatcaccccaatgcagtacaaggccatgcaagctgcgggtcagattccagccactgctcttctccccaccatgacccctgacggtctggctgtgaccccaacgccggtgcccgtggtcgggagccagatgaccagacaagcccggcgcctctacgtgggcaacatcccctttggcatcactgaggtgaaatattgtggggctgagatccctcgtagcaacaaaaagtttgctaccatcgtcgaaggcaagtaaggtccattctgactttctcaacctgcactttgctacatttgataaaccagcccccggactccagggccagattcctccacatcactcttttctcctcccctcccgtcc

SEQ ID NO: 298971 - DNA, 1519 bp, Homo sapiens
gtgcctagagatcccccgcctcaccacccaaacaggacagatatttgcctttttggattccgctcagtggacgagactacccaggctatggcctttgatggcatcatcttccagggccagtcactaaagatccgcaggcctcacgactaccagccgcttcctggcatgtcagagaacccctccgtctatgtgcctggggttgtgtccactgtggtccccgactctgcccacaagctgttcatcgggggcttacccaactacctgaacgatgaccaggtcaaagagctgctgacatcctttgggcccctcaaggccttcaacctggtcaaggacagtgccacggggctctccaagggctacgccttctgtgagtacgtggacatcaacgtcacggatcaggccattgcggggctgaacggcatgcagctgggggataagaagctgctggtccagagggcgagtgtgggagccaagaatgccacgcttgagcaccatcaatcagacgcctgtgaccctgcaagtgccgggcttgatgagctcccaggtgcagatgggcggccacccgactgaggtcctgtgcctcatgaacatggtgctgcctgaggagctgctggacgacgaggagtatgaggagatcgtggaggatgtgcgggacgagtgcagcaagtacgggcttgtcaagtccatcgagatcccccggcctgtggacggcgtcgaggtgcccggctgcggaaagatctttgtggagttcacctctgtgtttgactgccagaaagccatgcagggcctgacgggccgcaagttcgccaacagagtggttgtcacaaaatactgtgaccccgactcttatcaccgccgggacttctggtagaggcggctgggggagggtgggggcagggctggctgggggcttctccccactcccgccccccccttatccccctctgaagacgatgggcagaggagtgacagccgcagacacacgacagccggcagcaactggaatggcagcaattaagggtggggggcgggggttggggggttggggggttagggcagggaggggactggggaagtgcgcacacagcccacacagacaacacgcacccacacagacacagagggaaggggttgggatggggacagggtgcacagcagggcggggtaggaccccagcccctcccaaaacagcctctcctactcccatagacccctttcttctccccttccccacggtaggaacatagcgtgtttatattttatggccaaactattttgaattttgttgtccggccctcagtgccctgccctctcccttaccaggaccacagctctgttccttcggcctctggtcctctctggtcccctcctgggtttcttacgtagttgatttttcctctttagtctcccccgacctgcgcccagccccgtggcccctgcccctctcctactctctgtggcagtttcatatttgctaagacgaatttgctcattaaacattttgttgtattttacttta

SEQ ID NO: 298972 - DNA, 1103 bp, Homo sapiens
gcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcggccctgccctctcccttaccaggaccacagctctgttccttcggcctctggtcctctctggtcccctcctgggtttcttacgtagttgatttttcctctttagtctcccccgacctgcgcccagccccgtggcccctgcccctctcctactctctgtggcagtttcatatttgctaagacgaatttgctcattaaacattttgttgtattttacttta

SEQ ID NO: 298973 - DNA, 1362 bp, Homo sapiens
gcacccttcatccctcttgctgcttttgtctggcacaaccttctcaggccctccgcgaggccggccctttttttctttcactttccccacccggagagccaggtgccgagaactaggacctcgtccccttctctatcccttcccctgatccatctcgtctctgttctccttcccttttccgttcccgaagccggaaggagccgaggtacccacggaaaaagtcgaagctgtccccggagagtgaggccttcacgaagcggtggcggaaggagccgaagttctctgatcggaggcgtgagcaagtggcatctccggaaagagccgaaacacggactcgagcttaatcccaggaggggcccgagggcgagatccggaaatctccggaaagagccgaaggccgggacggttaggattgtcggaagtggccgattgcttggacagggccggcggagaagatcggagcaagtccgtggaagaagccaaagactgggacggattgaattgttggaagaacccgaactcgcagaggggactgggcgcagtggcacacgaggacacacggaaacctccgaacgttgaggagataatctcggaaaagttacggaaacctgggaagtcggcgaaaccctacgttcgggtgttttcggaagcagccgaagcggccgctgcttcgccttcgtccagtatccggagatagccgaggcgcttcggagccaggctcggggggaggggcaagctcgcgggcgggcgggcgggtgagggggcggagcccgggcggggcggggagggctgccggaggcttgattaggtaggaggtggcgaagcgccggcggcggccggaagtagccgaagccagcggcggaagtagccgaagcggctggagcgggcggcaaggcgaggcgaaagctgcacagggccctacgcggccgcctcagcatgtcggacttcgacgagttcgagcggcagctcaacgagaataaacaaggtgagggcaccggggtcgcggggcggaggtgtgggcggctcctcgcgtcgctctttgcccccccgccattttctccctcgcttccccccacttcacggccgcgcggcgccccccaaccctggttccgtggcgcgcgcctcgttcacgtgacgtccccagcgttccgccgcgcgctaggcgaggggaagggggcggcggggcgcgggcccgtgacgcatgcgcacggcggctgtccctgcgccccacgtggtcctggcggaggtggcgcgggggacgcggcacgagcgcgccagatgcctcgacgtgaacttttgttttttaaaatctttttggtttctctgaaaaggagattatgttagtccccgtaatctcttttc

SEQ ID NO: 298974 - DNA, 304 bp, Homo sapiens
gagtgtgagctcctggcagcagggacatgcgtgtctgttgtactcccagtgcccagcctggggcctggcatgttgtatttgttcacatgagtgaaaggaaagaggaaatcccaatcctggaacactaggggctgtactagtccctgacccccatccctcaccactcctttctctttcattcagttccgctcagtggacgagactacccaggctatggcctttgatggcatcatcttccagggccagtcactaaagatccgcaggcctcacgactaccagccgcttcctggcatgtcagagaacc

SEQ ID NO: 298975 - DNA, 2536 bp, Homo sapiens
cctagcgctcctctccggcttccaccagcccatcgctccacgctctcttggctgctgcagtctcggtctctctctctctctctctctctctctctctctctctctctctctctctctctctctctctctctctctcccaagtttcctatctcgtcaagatcagggcaaaagaagaaaacaccgaattctgcttgccgtttcagagcggcggtgatgaagacaaaattgaacatctacaacatgcgagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaagaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactaccttaattaaaaaaaaagaaaagaaatgtgtcttaacatttccaggtatgtgttgtattgaaattgatcagctaaattttacgggtgctggagactggaaaaagcatccagtttggttgctgtggagcaacatgcatattggattagaaaattgtgccaaaaactcccactgatgagaattcataggtgccccacactgtgacaaacacttatatgattctcctctttcctgt

SEQ ID NO: 298976 - DNA, 1197 bp, Homo sapiens
aatcgtactcaagatcctatgcgtttcctgagttacaacagtggatacagtgcagagaatctatagaagacgtcagcataggcgccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactaccttaattaaaaaaaaagaaaagaaatgtgtcttaacatttccaggtatgtgttgtattgaaattgatcagctaaattttacgggtgctggagactggaaaaagcatccagtttggttgctgtggagcaacatgcatattggattagaaaattgtgccaaaaactcccactgatgagaattcataggtgccccacactgtgacaaacacttatatgattctcctctttcctgt

SEQ ID NO: 298977 - DNA, 2479 bp, Homo sapiens
agcaagcggcctcggggagcagcccgaggctgcgcgtgggctccgctcctccggcgaggtgtgggcgaggggagcggcgctccgagcgcacccaggcgcccgacgccgcccgggtctgcgccgctgctagtgccaggcgggcgacgagcggcggtgatgaagacaaaattgaacatctacaacatgcgagttcctgctttttgttttcttggtgtgggaccctgccaggttggtgctggctaacatccaagaagatgaggctaaaaataacattaccatctttacgagaattcttgacagacttctggatggttacgataatcggcttagaccaggactgggagacagtattactgaagtcttcactaacatctacgtgaccagttttggccctgtctcagatacagatatggaatatacaattgatgttttctttcgacaaaaatggaaagatgaacgtttaaaatttaaaggtcctatgaatatccttcgactaaacaatttaatggctagcaaaatctggactccagataccttttttcacaatgggaagaaatcagtagctcataatatgacaatgccaaataagttgcttcgaattcaggatgatgggactctgctgtataccatgaggcttacagttcaagctgaatgcccaatgcacttggaggatttcccaatggatgctcattcatgtcctctgaaatttggcagctatgcatatacaacttcagaggtcacttatatttggacttacaatgcatctgattcagtacaggttgctcctgatggctctaggttaaatcaatatgacctgctgggccaatcaatcggaaaggagacaattaaatccagtacaggtgaatatactgtaatgacagctcatttccacctgaaaagaaaaattgggtattttgtgattcaaacctatctgccttgcatcatgactgtcattctctcccaagtttcattctggcttaacagagaatctgtgcctgcaagaactgtgtttggagtaacaactgtcctaacaatgacaactctaagcatcagtgctcggaattctctccccaaagtggcttatgcaactgccatggactggtttattgctgtttgttatgcatttgtgttctctgccctaattgaatttgcaactgttaattacttcaccaaaagaggatgggcttgggatgggaagagtgtagtaaatgacaagaaaaaagaaaaggcttccgttatgatacagaacaacgcttatgcagtggctgttgccaattatgccccgaatctttcaaaagatccagttctctccaccatctccaagagtgcaaccacgccagaacccaacaagaagccagaaaacaagccagctgaagcaaagaaaactttcaacagtgttagcaaaattgacagaatgtccagaatagtttttccagttttgtttggtacctttaatttagtttactgggctacatatttaaacagagaacctgtattaggggtcagtccttgaattgagacccatgttatctttgggatgtatagcaacattaaatttggtttgttttgctatgtacagtctgactaataactgctaatttgtgatccaacatgtacagtatgtatatagtgacatagcttaccagtagacctttaatggagacatgcatttgctaactcatggaactgcagacagaaagcactccatgcgaaaacagccattgccttttttaaagatttaccctaggacctgatttaaagtgaatttcaagtgacctgattaatttcctattcttccaaatgagatgaaaatggggatcctgtacaaccctttgtggacccttttggtttagctcttaagtaggggtattttctactgttgcttaattatgatggaagataacattgtcattcctagatgaatcctttgaagtaacaaacattgtatctgacatcagctctgttcatgagtgctcagagtccctgctaatgtaattggaagcttggtacacataagaaaaactagagatttgaaatcagctatgaattactctatatagtatctatagccatgtacatattacagcatgacaagctcaaataattatgagtcagcccgaaaggatgttaattatgcctacgatgtaataactattggaatgtcatggtcattacatttttagcttcagagtttatttgaaagtaataattgaaatcctacaatttattttaatcattggaaactaccttaattaaaaaaaaagaaaagaaatgtgtcttaacatttccaggtatgtgttgtattgaaattgatcagctaaattttacgggtgctggagactggaaaaagcatccagtttggttgctgtggagcaacatgcatattggattagaaaattgtgccaaaaactcccactgatgagaattcataggtgccccacactgtgacaaacacttatatgattctcctctttcctgt

SEQ ID NO: 298978 - DNA, 228 bp, Homo sapiens
tgtgttctctgccctaattgaatttgcaactgttaattacttcaccaaaagaggatgggcttgggatgggaagagtgtagtaaatgacaaggtaagtgagagcttccgtgttatcattattaagaaaataccctaatgaattccgcttgtaacagatatgtttctaaaatcctgacattaaagacatccatatatatatgaatttgaatcatatcaatttcttttaaa

SEQ ID NO: 298979 - DNA, 694 bp, Homo sapiens
ttttaaaaggatttgcaacttgatgcaagtatagcgttattatttatcttatatgttctataataattactttttattctaatgaaatgcattgtattatgatagctaactcatttaactcttaactaggctacatttatgtccaaaaattaatataattttgaattttgatttttatcttatgagtgattgctatttataaataagctaaacagcttattttaccacagtgtcttcatatgctacctttggcctaaaggagatgttataatcatctaagggcccagtgattctaacagactctaacaagaaatttgctcttcacctttcaaagtggttgcaatgaatatactgtcatggtcatgatcatctcttttggtctacttcataactctcatattgaagtaaattcaaatgagacatttttgccctaaatgtgatgtttaactattaatattgaaagtatatagtgattgtatgaaatacacaaccgttcgtgtagcactagattgatggttcttactaaaatgcttaaaatattttttctgatttcctatagatgcatatacaacttcagaggtcacttatatttggacttacaatgcatctgattcagtacaggttgctcctgatggctctaggttaaatcaatatgacctgctgggccaatcaatcggaaaggagacaattaaat

SEQ ID NO: 298980 - DNA, 1969 bp, Homo sapiens
acccgaaggcgcgagggcgcgcctgagccgccatgtcggaggcgcgtggagagccagggtccgggcctgaggctggcgcccgattcttctgcactgcgggtcgcggcctggagccgttcgtaatgcgagaggtgcgggcgcggctggcggccacgcaggttgaatatatttcaggaaaggtttttttcaccacctgttctgatttgaatatgttgaagaaattaaaatctgcagaaagattatttttgctgattaaaaagcagtttccacttattatttcttctgtaagtaaaggaaaaatatttaatgaaatgcaaagacttataaatgaagatccaggaagttggttgaatgccatttcaatttggaaaaatcttcttgaacttgatgcaaaaaaggaaaaactttctcagagagatgataaccaactaaaaagaaaagtgggagaaaatgaaatcattgcaaagaaattaaaaatagaacaaatgcaaaagatagaagagaatagggactgccagctggaaaaacaaataaaagaagaaactctggagcaaagagattttaccactaaaagcgaaaagtttcaagaagaagaatttcagaatgacatagagaaagcaattgatactcataatcagaatgacttgactttcagagtatcttgtcgctgcagtggaactattggaaaggccttcactgcacaggaggtaggaaaagtaattggaattgctattatgaaacactttggatggaaagcagacttgaggaatccacaattagagatctttatacatctaaatgacatttactctgtggtggggattcctgtgttcagggtttccctagccagcagagcttacatcaagacagctggactgcgatctacaatagcgtgggcaatggcatctctggctgacattaaggctggtgcatttgttttagatccaatgtgtggacttggaacaatacttttggaagctgctaaagaatggccagatgtgtattatgtaggtgctgatgtcagcgactcacagttactaggtacttgggacaatctgaaagctgcaggccttgaggataaaattgaattacttaaaatctctgttatagaattgccattgccttcagaaagtgttgatattattatttctgacattccatttgggaaaaagtttaagttaggaaaagacatcaaaagcattctacaagaaatggaaagagtgcttcatgttggcggaaccattgtattgttgcttagtgaagatcaccacaggcgccttacagattgtaaagagagcaacatccctttcaattccaaggacagtcacacagatgaacctggaattaaaaagtgcttgaatcctgaagaaaaaactggtgcattcaagacagcgtcaacttcattcgaagccagtaaccacaaattcttagacagaatgtcaccatttggctccttggtaccagtggaatgctacaaagttagccttggaaagacagatgcgttcatatgtaaatataagaagtcgcactcttctggactgtagcaggcttgctgccatcagccgggttcaggcccttgtaagttagctgtacagcagaagtttgctgtctctaggattcatatagcacccacagagctccaagtaaccaaattcccccaaagacaggaggtgtggctgatgggtacacatgcttggtaagagtttctgctttatattctaaagtacttaatgtttttgagaaaaaagttaccgaatattttttagacttaagttttatcttctgtcagaatgtgaaaagttctgcccagtttctgagcaaaaacttcaatttcaaaataaaggttttcaggggttcacttaagtgtatcacaatcaacaccagacgggatattttaactatcagattttcggaaatgtaaaaacctttatgtgtaacttcttttgatattaaacttgatttttgagcc

SEQ ID NO: 298981 - DNA, 954 bp, Homo sapiens
acccgaaggcgcgagggcgcgcctgagccgccatgtcggaggcgcgtggagagccagggtccgggcctgaggctggcgcccgattcttctgcactgcgggtcgcggcctggagccgttcgtaatgcgagaggtgcgggcgcggctggcggccacgcaggttgaatatatttcaggaaaggtttttttcaccacctgttctgatttgaatatgttgaagaaattaaaatctgcagaaagattatttttgctgattaaaaagcagtttccacttattatttcttctgtaagtaaaggaaaaatatttaatgaaatgcaaagacttataaatgaagatccaggaagttggttgaatgccatttcaatttggaaaaatcttcttgaacttgatgcaaaaaaggaaaaactttctcagagagatgataaccaactaaaaagaaaagtgggagaaaatgaaatcattgcaaagaaattaaaaatagaacaaatgcaaaagatagaagagaatagggactgccagctggaaaaacaaataaaagaagaaactctggagcaaagagattttaccactaaaagcgaaaagtttcaagaagaagaatttcagaatgacatagagaaagcaattgatactcataatcagaatgacttgactttcagagtatcttgtcgctgcagtggaactattggaaaggccttcactgcacaggaggtaggaaaagtaattggaattgctattatgaaacactttggatggaaagcagacttgaggaatccacaattagagatcttattactctaaatgacatttacttcgtggtggggatccctggttcaggtttccctaaacagcagagttacttcagacggtggctgcgatctacatagcgtgggcaggctttcggtgacttaagcggggctgttgatctcggtggctggcaccatttggaggcaaaagc

SEQ ID NO: 298982 - DNA, 491 bp, Homo sapiens
gcgggagccaccatgcctggcctgggggtcccattttttaaagaattaattattctttagatttaaaatgagatgcaaacctctcacagaacaaataactagccgcagacaattagttcttatggaattaaatgtctttaaaactacattttccttttaatttttcctcagatgtttaagaggaatggtatgccattccaagtaatgactttcttatactttctgcctaaaaatttccttaaatctacagatgtcctttgtatttggaaatcctgataccatagtcctcagcttttggggtttctcttcagttcagctttgtgcttattcagtggctactctgcacaggtcctgtacatgggattgtcaccaggacctagactgcaaatgcacatgaggtctcagcaatgtagagaagagcgaacaccacaaactgttgccatcaccagacctcatcagttggcccttacaaagttcagtgatgttaaagg

SEQ ID NO: 298983 - DNA, 2090 bp, Homo sapiens
acccgaaggcgcgagggcgcgcctgagccgccatgtcggaggcgcgtggagagccagggtccgggcctgaggctggcgcccgattcttctgcactgcgggtcgcggcctggagccgttcgtaatgcgagaggtgcgggcgcggctggcggccacgcaggttgaatatatttcaggaaaggtttttttcaccacctgttctgatttgaatatgttgaagaaattaaaatctgcagaaagattatttttgctgattaaaaagcagtttccacttattatttcttctgtaagtaaaggaaaaatatttaatgaaatgcaaagacttataaatgaagatccaggaagttggttgaatgccatttcaatttggaaaaatcttcttgaacttgatgcaaaaaaggaaaaactttctcagagagatgataaccaactaaaaagaaaagtgggagaaaatgaaatcattgcaaagaaattaaaaatagaacaaatgcaaaagatagaagagaatagggactgccagctggaaaaacaaataaaagaagaaactctggagcaaagagattttaccactaaaagcgaaaagtttcaagaagaagaatttcagaatgacatagagaaagcaattgatactcataatcagaatgacttgactttcagagtatcttgtcgctgcagtggaactattggaaaggccttcactgcacaggaggtaggaaaagtaattggaattgctattatgaaacactttggatggaaagcagacttgaggaatccacaattagagatctttatacatctaaatgacatttactctgtggtggggattcctgtgttcagggtttccctagccagcagagcttacatcaagacagctggactgcgatctacaatagcgtgggcaatggcatctctggctgacattaaggtaccatatggctctgactgaaacctggctgtgcactgaggactctgcttcctctgtagacatatcaagtggtggatgtcttttctcccctatctcgagcacgactgggcctgacagtggggctggtgcatttgttttagatccaatgtgtggacttggaacaatacttttggaagctgctaaagaatggccagatgtgtattatgtaggtgctgatgtcagcgactcacagttactaggtacttgggacaatctgaaagctgcaggccttgaggataaaattgaattacttaaaatctctgttatagaattgccattgccttcagaaagtgttgatattattatttctgacattccatttgggaaaaagtttaagttaggaaaagacatcaaaagcattctacaagaaatggaaagagtgcttcatgttggcggaaccattgtattgttgcttagtgaagatcaccacaggcgccttacagattgtaaagagagcaacatccctttcaattccaaggacagtcacacagatgaacctggaattaaaaagtgcttgaatcctgaagaaaaaactggtgcattcaagacagcgtcaacttcattcgaagccagtaaccacaaattcttagacagaatgtcaccatttggctccttggtaccagtggaatgctacaaagttagccttggaaagacagatgcgttcatatgtaaatataagaagtcgcactcttctggactgtagcaggcttgctgccatcagccgggttcaggcccttgtaagttagctgtacagcagaagtttgctgtctctaggattcatatagcacccacagagctccaagtaaccaaattcccccaaagacaggaggtgtggctgatgggtacacatgcttggtaagagtttctgctttatattctaaagtacttaatgtttttgagaaaaaagttaccgaatattttttagacttaagttttatcttctgtcagaatgtgaaaagttctgcccagtttctgagcaaaaacttcaatttcaaaataaaggttttcaggggttcacttaagtgtatcacaatcaacaccagacgggatattttaactatcagattttcggaaatgtaaaaacctttatgtgtaacttcttttgatattaaacttgatttttgagcc

SEQ ID NO: 298984 - DNA, 1411 bp, Homo sapiens
ttaaaacatagatcatgtaagtttaaaatggaaatttcaaattgtcagtaatttggtaatgaagtttcttgttccattctaacttctgtgtttgttctttcagatctttatacatctaaatgacatttactctgtggtggggattcctgtgttcagggtttccctagccagcagagcttacatcaagacagctggactgcgatctacaatagcgtgggcaatggcatctctggctgacattaaggtaccatatggctctgactgaaacctggctgtgcactgaggactctgcttcctctgtagacatatcaagtggtggatgtcttttctcccctatctcgagcacgactgggcctgacagtggggctggtgcatttgttttagatccaatgtgtggacttggaacaatacttttggaagctgctaaagaatggccagatgtgtattatgtaggtgctgatgtcagcgactcacagttactaggtacttgggacaatctgaaagctgcaggccttgaggataaaattgaattacttaaaatctctgttatagaattgccattgccttcagaaagtgttgatattattatttctgacattccatttgggaaaaagtttaagttaggaaaagacatcaaaagcattctacaagaaatggaaagagtgcttcatgttggcggaaccattgtattgttgcttagtgaagatcaccacaggcgccttacagattgtaaagagagcaacatccctttcaattccaaggacagtcacacagatgaacctggaattaaaaagtgcttgaatcctgaagaaaaaactggtgcattcaagacagcgtcaacttcattcgaagccagtaaccacaaattcttagacagaatgtcaccatttggctccttggtaccagtggaatgctacaaagttagccttggaaagacagatgcgttcatatgtaaatataagaagtcgcactcttctggactgtagcaggcttgctgccatcagccgggttcaggcccttgtaagttagctgtacagcagaagtttgctgtctctaggattcatatagcacccacagagctccaagtaaccaaattcccccaaagacaggaggtgtggctgatgggtacacatgcttggtaagagtttctgctttatattctaaagtacttaatgtttttgagaaaaaagttaccgaatattttttagacttaagttttatcttctgtcagaatgtgaaaagttctgcccagtttctgagcaaaaacttcaatttcaaaataaaggttttcaggggttcacttaagtgtatcacaatcaacaccagacgggatattttaactatcagattttcggaaatgtaaaaacctttatgtgtaacttcttttgatattaaacttgatttttgagcc

SEQ ID NO: 298985 - DNA, 2341 bp, Homo sapiens
acccgaaggcgcgagggcgcgcctgagccgccatgtcggaggcgcgtggagagccagggtccgggcctgaggctggcgcccgattcttctgcactgcgggtcgcggcctggagccgttcgtaatgcgagaggtgcgggcgcggctggcggccacgcaggttgaatatatttcaggaaaggtttttttcaccacctgttctgatttgaatatgttgaagaaattaaaatctgcagaaagattatttttgctgattaaaaagcagtttccacttattatttcttctgtaagtaaaggaaaaatatttaatgaaatgcaaagacttataaatgaagatccaggaagttggttgaatgccatttcaatttggaaaaatcttcttgaacttgatgcaaaaaaggaaaaactttctcagagagatgataaccaactaaaaagaaaagtgggagaaaatgaaatcattgcaaagaaattaaaaatagaacaaatgcaaaagatagaagagaatagggactgccagctggaaaaacaaataaaagaagaaactctggagcaaagagattttaccactaaaagcgaaaagtttcaagaagaagaatttcagaatgacatagagaaagcaattgatactcataatcagaatgacttgactttcagagtatcttgtcgctgcagtggaactattggaaaggccttcactgcacaggaggtaggaaaagtaattggaattgctattatgaaacactttggatggaaagcagacttgaggaatccacaattagagatctttatacatctaaatgacatttactctgtggtggggattcctgtgttcagggtttccctagccagcagagcttacatcaagacagctggactgcgatctacaatagcgtgggcaatggcatctctggctgacattaaggtaccatatggctctgactgaaacctggctgtgcactgaggactctgcttcctctgtagacatatcaagtggtggatgtcttttctcccctatctcgagcacgactgggcctgacagtggggctggtgcatttgttttagatccaatgtgtggacttggaacaatacttttggaagctgctaaagaatggccagatgtgtattatgtaggtgctgatgtcagcgactcacagttactaggtacttgggacaatctgaaagctgcaggccttgaggataaaattgaattacttaaaatctctgttatagaattgccattgccttcagaaagtgttgatattattatttctgacattccatttgggaaaaagtttaagttaggaaaagacatcaaaagcattctacaagaaatggaaagagtgcttcatgttggcggaaccattgtattgttgcttagtgaagatcaccacaggcgccttacagattgtaaagagagcaacatccctttcaattccaaggacagtcacacagatgaacctggaattaaaaagtgcttgaatcctgaagaaaaaactggtgcattcaagacagcgtcaacttcattcgaagccagtaaccacaaattcttagacagaatgtcaccatttggctccttggtaccagtggaatgctacaaagttagccttggaaagacagatgcgttcatatgtaaatataagaagtcgcactcttctggactgtagcaggcttgctgccatcagccgggttcaggcccttgtaagttagctgtacagcagaagtttgctgtctctaggattcatatagcacccacagagctccaagtaaccaaattcccccaaagacaggaggtgtggctgatgggtacacatgcttggtaagagtttctgctttatattctaaagtacttaatgtttttgagaaaaaagttaccgaatattttttagacttaagttttatcttctgtcagaatgtgaaaagttctgcccagtttctgagcaaaaacttcaatttcaaaataaaggttttcaggggttcacttaagtgtatcacaatcaacaccagacgggatattttaactatcagattttcggaaatgtaaaaacctttatgtgtaacttcttttgatattaaacttgatttttgagccagcctgtaattttcttctccattggaatgaaaataatttgtatttgcaatacattttatatgtttattatgtaaaccaacagtgagaataataactgaattaagccagtatccttcaaaacatgatggaaaatgaaatttgctttttttctaaaagcattcatacactgtcacctcgcccttatttatatagaaagtcagtttgttgcttatgttcactacctgagaaaaagaaacagtaagtttgaggag

SEQ ID NO: 298986 - DNA, 2322 bp, Homo sapiens
acccgaaggcgcgagggcgcgcctgagccgccatgtcggaggcgcgtggagagccagggtccgggcctgaggctggcgcccgattcttctgcactgcgggtcgcggcctggagccgttcgtaatgcgagaggtgcgggcgcggctggcggccacgcaggttgaatatatttcaggaaaggtttttttcaccacctgttctgatttgaatatgttgaagaaattaaaatctgcagaaagattatttttgctgattaaaaagcagtttccacttattatttcttctgtaagtaaaggaaaaatatttaatgaaatgcaaagacttataaatgaagatccaggaagttggttgaatgccatttcaatttggaaaaatcttcttgaacttgatgcaaaaaaggaaaaactttctcagagagatgataaccaactaaaaagaaaagtgggagaaaatgaaatcattgcaaagaaattaaaaatagaacaaatgcaaaagatagaagagaatagggactgccagctggaaaaacaaataaaagaagaaactctggagcaaagagattttaccactaaaagcgaaaagtttcaagaagaagaatttcagaatgacatagagaaagcaattgatactcataatcagaatgacttgactttcagagtatcttgtcgctgcagtggaactattggaaaggccttcactgcacaggaggtaggaaaagtaattggaattgctattatgaaacactttggatggaaagcagacttgaggaatccacaattagagatctttatacatctaaatgacatttactctgtggtggggattcctgtgttcagggtttccctagccagcagagcttacatcaagacagctggactgcgatctacaatagcgtgggcaatggcatctctggctgacattaaggtaccatatggctctgactgaaacctggctgtgcactgaggactctgcttcctctgtagacatatcaagtggtggatgtcttttctcccctatctcgagcacgactgggcctgacagtggggctggtgcatttgttttagatccaatgtgtggacttggaacaatacttttggaagctgctaaagaatggccagatgtgtattatgtaggtgctgatgtcagcgactcacagttactaggtacttgggacaatctgaaagctgcaggccttgaggataaaattgaattacttaaaatctctgttatagaattgccattgccttcagaaagtgttgatattattatttctgacattccatttgggaaaaagtttaagttaggaaaagacatcaaaagcattctacaagaaatggaaagagtgcttcatgttggcggaaccattgtattgttgcttagtgaagatcaccacaggcgccttacagattgtaaagagagcaacatccctttcaattccaaggacagtcacacagatgaacctggaattaaaaagtgcttgaatcctgaagaaaaaactggtgcattcaagacagcgtcaacttcattcgaagccagtaaccacaaattcttagacagaatgtcaccatttggctccttggtaccagtggaatgctacaaagttagccttggaaagacagatgcgttcatatgtaaatataagaagtcgcactcttctggactgtagcaggcttgctgccatcagccgggttcaggcccttgtaatttgctgtctctaggattcatatagcacccacagagctccaagtaaccaaattcccccaaagacaggaggtgtggctgatgggtacacatgcttggtaagagtttctgctttatattctaaagtacttaatgtttttgagaaaaaagttaccgaatattttttagacttaagttttatcttctgtcagaatgtgaaaagttctgcccagtttctgagcaaaaacttcaatttcaaaataaaggttttcaggggttcacttaagtgtatcacaatcaacaccagacgggatattttaactatcagattttcggaaatgtaaaaacctttatgtgtaacttcttttgatattaaacttgatttttgagccagcctgtaattttcttctccattggaatgaaaataatttgtatttgcaatacattttatatgtttattatgtaaaccaacagtgagaataataactgaattaagccagtatccttcaaaacatgatggaaaatgaaatttgctttttttctaaaagcattcatacactgtcacctcgcccttatttatatagaaagtcagtttgttgcttatgttcactacctgagaaaaagaaacagtaagtttgaggag

SEQ ID NO: 298987 - DNA, 945 bp, Homo sapiens
acccgaaggcgcgagggcgcgcctgagccgccatgtcggaggcgcgtggagagccagggtccgggcctgaggctggcgcccgattcttctgcactgcgggtcgcggcctggagccgttcgtaatgcgagaggtgcgggcgcggctggcggccacgcaggttgaatatatttcaggaaaggtttttttcaccacctgttctgatttgaatatgttgaagaaattaaaatctgcagaaagattatttttgctgattaaaaagcagtttccacttattatttcttctgtaagtaaaggaaaaatatttaatgaaatgcaaagacttataaatgaagatccaggaagttggttgaatgccatttcaatttggaaaaatcttcttgaacttgatgcaaaaaaggaaaaactttctcagagagatgataaccaactaaaaagaaaagtgggagaaaatgaaatcattgcaaagaaattaaaaatagaacaaatgcaaaagatagaagagaatagggactgccagctggaaaaacaaataaaagaagaaactctggagcaaagagattttaccactaaaagcgaaaagtttcaagaagaagaatttcagaatgacatagagaaagcaattgatactcataatcagaatgacttgactttcagagtatcttgtcgctgcagtggaactattggaaaggccttcactgcacagatgtcctttgtatttggaaatcctgataccatagtcctcagcttttggggtttctcttcagttcagctttgtgcttattcagtggctactctgcacaggtcctgtacatgggattgtcaccaggacctagactgcaaatgcacatgaggtctcagcaatgtagagaagagcgaacaccacaaactgttgccatcaccagacctcatcagttggcccttacaaagttcagtgatgttaaagg

SEQ ID NO: 298988 - DNA, 766 bp, Homo sapiens
acccgaaggcgcgagggcgcgcctgagccgccatgtcggaggcgcgtggagagccagggtccgggcctgaggctggcgcccgattcttctgcactgcgggtcgcggcctggagccgttcgtaatgcgagaggtgcgggcgcggctggcggccacgcaggttgaatatatttcaggaaaggtttttttcaccacctgttctgatttgaatatgttgaagaaattaaaatctgcagaaagattatttttgctgattaaaaagcagtttccacttattatttcttctgtaagtaaaggaaaaatatttaatgaaatgcaaagacttataaatgaagatccaggaagttggttgaatgccatttcaatttggaaaaatcttcttgaacttgatgcaaaaaaggaaaaactttctcagagagatgataaccaactaaaaagaaaagtgggagaaaatgaaatcattgcaaagaaattaaaaatagaacaaatgcaaaagatagaagagaatagggactgccagctggaaaaacaaataaaagaagaaactctggagcaaagagattttaccactaaaagcgaaaagtttcaagaagaagaatttcagaatgacatagagaaagcaattgatactcataatcagaatgacttgactttcagagtatcttgtcgctgcagtggaactattggaaaggccttcactgcacaggtatgcttgcatcctaaagtggagtctgtcgcccaggctggaatgcagttgcacaatctggc

SEQ ID NO: 298989 - DNA, 346 bp, Homo sapiens
gcgatctacaatagcgtgggcaatggcatctctggctgacattaaggtaagaaaaatgttttccttcctgttaatagcaaggttcttttcataattaacttatacagtctcttattgatggatatttatgttacttgctttttcttttcttgacgctttttctttaacttcttttctttttgccattgtacttacaaactgctgcagtaatgcttttatatattattgaacttctgagagtattttggctctgaaaaagctgagtcaaaagttagctacatttcattatttctaatgttttgtgtcacagttagaaaatgtggcctgtaaaacctcctattcttaa

SEQ ID NO: 298990 - DNA, 430 bp, Homo sapiens
agtcgattttcttaactacatgaaatatgtaataattttatttatgcttaaaatatttatttccccataggatgtgtattatgtaggtgctgatgtcagcgactcacagttactaggtacttgggacaatctgaaagctgcaggccttgaggataaaattgaattacttaaaatctctgttataggtaagatactaaaaatgcaaaacaattgagaaaaggaacaatgtaaatatatttagaatcataatataaaacaagtctcactatgtaaaggttggttttaccctttaatatatctgtgggactaatactcagtttacttctaatagtctaacctttttattttcaaagtgttcataattgggaagcaacaattctatagttttcgtaagcatgtaaagcatgacttcttaaaatgtgtttgttaa

SEQ ID NO: 298991 - DNA, 293 bp, Homo sapiens
actgacactggactacattaaaagctgtttttctatttctaggttgaatatatttcaggaaaggtttttttcaccacctgttctgatttgaatatgttgaagaaattaaaatctgcagaaagattatttttgctgattaaaaagcagtttccacttattatttcttctgtaagtaaaggtatggcatattcatatgcatgttgcttttacccacatgatacattgtactccaacattttctgcttgataatatgtagccattttacactttaatattcattgacatgtgtggg

SEQ ID NO: 298992 - DNA, 1005 bp, Homo sapiens
  misc_feature (33)..(33): n is a, c, g, or t
ggctacacggtataggtctaggtacgaggctgngtggtggcagcacctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaaaattacctgtctcaaaaaaaaaaaa

SEQ ID NO: 298993 - DNA, 980 bp, Homo sapiens
  misc_feature (33)..(33): n is a, c, g, or t
ggctacacggtataggtctaggtacgaggctgngtggtggcagcacctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaa

SEQ ID NO: 298994 - DNA, 675 bp, Homo sapiens
gggcgcccgcagcacctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacatgtgtaaaggtttcatgttcactgtgagtgaaaatttttacattcatcaatatccctcttgtaagtcatctacttaataaatattacagtgaa

SEQ ID NO: 298995 - DNA, 918 bp, Homo sapiens
tcacttatgtatccttctaataaatttgctgctttaaaaaaaaaacctgaataacttggaatttttttgttgttgctttttgtttttttgagacggagtctcactctttcgcccaggctggagtgcagtggcactatctcggctaacttcaagctccgcctcctgggttcatgccattctcctgcctcagcctcccaagtagctgggactacaaggtgcccgccaccacaatcagctaattttttgtattttcagtagagatggggtttcactgtgttagccaggatggtctcgatctcctgaccttgtgatccacccgcctcagcctcccaaagtgctgggattacaggcgtgagccaccccgcccagcataacttggcatttttgctgtaaagttactttctctggatcttaactggtcccacaaatgataaggatgaaatgttggacatcctgggctcaggccagactggtttgaaattaatggacattttttccctttatttcagttgacaaaaaattgtttctatagtgcagatgaaatatgtatatattgtggaatgcctaaatccagctgacatatgcattacctcatgtaacagtttatgtatatgccatttcagatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaa

SEQ ID NO: 298996 - DNA, 432 bp, Homo sapiens
  misc_feature (382)..(382): n is a, c, g, or t
  misc_feature (386)..(386): n is a, c, g, or t
  misc_feature (389)..(389): n is a, c, g, or t
  misc_feature (395)..(395): n is a, c, g, or t
  misc_feature (413)..(413): n is a, c, g, or t
tccttgtaatccaagcagtcgcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgccactggcccctatggcgcccctgctgggccactgattgtgctttataacctgccttncctnggnggagtngtgcctcgactgcttgantaaaaggaggtaccgagct

SEQ ID NO: 298997 - DNA, 1634 bp, Homo sapiens
  misc_feature (33)..(33): n is a, c, g, or t
  misc_feature (1032)..(1032): n is a, c, g, or t
  misc_feature (1039)..(1039): n is a, c, g, or t
  misc_feature (1044)..(1044): n is a, c, g, or t
  misc_feature (1066)..(1066): n is a, c, g, or t
  misc_feature (1634)..(1634): n is a, c, g, or t
ggctacacggtataggtctaggtacgaggctgngtggtggcagcacctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaaaaaaaaaaaaaaaaaaaaaaaaaaaaaaaaaaaaaaaaaaaaaaaaaaaaanaaaaaanaaaanaaaaaaaaaaaaaaaacaaaanaaaaaaaaaaaaaacaagcgggggccgcgcccactataagtcggcacagagagaggacgacacagatacagaagcgcaccaacgatgaagtactaagaaaggccgaccccaaacagcacatcatcaaacacacccgacgcacggcacagtccaaacaaacacgagagctgacagaacactgctgaaggagatgagcgaagaaaaaccacacatccgtggcggaaaacaagtacgagcgacagcaatccaaaaacaaacacaaacagaaaaacaaaaccaccacatagcgtaaactatgacagcaccaacacgcagacatcacgaaagagaaaacaatcgatccgcatgattgaacaaaaatataacgcggagcgcgtacaaccagagacgaagaaccggaaaaacggagcaaaagcacccagacgaagcagcgacacacaccgaagcagacacgctcgaccagcagcagcacaccaacgagggaacgcgagagaccaaaggaaccagaaacaacgaagacgaaaagaagggagcggacagcaaacggatgtcaagctacacaaaatcn

SEQ ID NO: 298998 - DNA, 1053 bp, Homo sapiens
  misc_feature (33)..(33): n is a, c, g, or t
ggctacacggtataggtctaggtacgaggctgngtggtggcagcacctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaaaaaaaagagaaagccacacagacaacaaaacacacagcccgcggggacataacgggggaggaaaaagcgcgac

SEQ ID NO: 298999 - DNA, 1151 bp, Homo sapiens
  misc_feature (33)..(33): n is a, c, g, or t
  misc_feature (987)..(987): n is a, c, g, or t
ggctacacggtataggtctaggtacgaggctgngtggtggcagcacctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaaaaaaaanaagacaccaaatacaacacaccctggaagacaccattcgcggagggcggaaaaagagcgcagcgatgggcactgtgccaacacgtgttccggaaccagttttctcgccaccggggaaacaccgggcccatataggaacccatatgtccaaataccgggtacggt

SEQ ID NO: 299000 - DNA, 1594 bp, Homo sapiens
  misc_feature (33)..(33): n is a, c, g, or t
  misc_feature (992)..(992): n is a, c, g, or t
  misc_feature (999)..(999): n is a, c, g, or t
  misc_feature (1004)..(1004): n is a, c, g, or t
  misc_feature (1026)..(1026): n is a, c, g, or t
  misc_feature (1594)..(1594): n is a, c, g, or t
ggctacacggtataggtctaggtacgaggctgngtggtggcagcacctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaaaaaaaaaaaaanaaaaaanaaaanaaaaaaaaaaaaaaaacaaaanaaaaaaaaaaaaaacaagcgggggccgcgcccactataagtcggcacagagagaggacgacacagatacagaagcgcaccaacgatgaagtactaagaaaggccgaccccaaacagcacatcatcaaacacacccgacgcacggcacagtccaaacaaacacgagagctgacagaacactgctgaaggagatgagcgaagaaaaaccacacatccgtggcggaaaacaagtacgagcgacagcaatccaaaaacaaacacaaacagaaaaacaaaaccaccacatagcgtaaactatgacagcaccaacacgcagacatcacgaaagagaaaacaatcgatccgcatgattgaacaaaaatataacgcggagcgcgtacaaccagagacgaagaaccggaaaaacggagcaaaagcacccagacgaagcagcgacacacaccgaagcagacacgctcgaccagcagcagcacaccaacgagggaacgcgagagaccaaaggaaccagaaacaacgaagacgaaaagaagggagcggacagcaaacggatgtcaagctacacaaaatcn

SEQ ID NO: 299001 - DNA, 1328 bp, Homo sapiens
cctgggactcactcacagtaaccctttcaccaaaaggcccagggcggaagggagtggactctgccggcaggagctgagaaatcctctgagtagcgggaagtgcggtacagtctgggcattctgatgtttgtgattgtttttctcacggtgatgaaaaagtatgtgctataagtagaggagcgctaactcctgacttgagctaattatgaaaatgcagccctccctgatctgagacgttgggaggcaagaataaagtgaaaaagtatatgtaatcccaacatctaattttagtcttagaaactcaaactattaataagtggaaaaagtttaatgatatgcatgtaatgcctttgccatattcctctccttcttagatcacatattcctattttcctgaaaattctgcttttgagaatgctttctgtcccgtaattgtgtatgtctttctttccagctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaa

SEQ ID NO: 299002 - DNA, 949 bp, Homo sapiens
gggcgcccgcagcacctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaa

SEQ ID NO: 299003 - DNA, 990 bp, Homo sapiens
gggcgcccgcagcacctcctcgccagcagccgtccggagccagccaacgagcggggatgcattccaagaccccctgtggatgcttcaaaccatggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaa

SEQ ID NO: 299004 - DNA, 945 bp, Homo sapiens
aaaccaaatactcagctgcgttaggaattccttctgattcttgctgcaggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaa

SEQ ID NO: 299005 - DNA, 1013 bp, Homo sapiens
aaaccaaatactcagctgcgttaggaattccttctgattcttgctgcaggaaaatggcagacaatttttcggcccagggcggaagggagtggactctgccggcaggagctgagaaatcctctgagtagcgggaagtgcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaa

SEQ ID NO: 299006 - DNA, 1034 bp, Homo sapiens
aaaccaaatactcagctgcgttaggaattccttctgattcttgctgcaggaaaatggcagacaatttttcggcccagggcggaagggagtggactctgccggcaggagctgagaaatcctctgagtagcgggaagtgcggtacagtctgggcattctgatctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaa

SEQ ID NO: 299007 - DNA, 784 bp, Homo sapiens
gggcgcccgcagcacctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcctacccatcttctggacagccaagtgcccccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaa

SEQ ID NO: 299008 - DNA, 791 bp, Homo sapiens
gacggcagtgcatcgctgtatgcgtgcatgctgtctctagagtatccccccccctcgggcctaccccgggcaggcacccccaggggcttatcctggacaggcacctccaggcgcctaccatggagcacctggagcttatcccggagcacctgcacctggggcctacccatcttctggacagccaagtgcccccggagcctaccctgccactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaa

SEQ ID NO: 299009 - DNA, 1147 bp, Homo sapiens
cctgggactcactcacagtaaccctttcaccaaaaggcccagggcggaagggagtggactctgccggcaggagctgagaaatcctctgagtagcgggaagtgcggtacagtctgggcattctgatgtttgtgattgtttttctcacggtgatgaaaaagtatgtgctataagtagaggagcgctaactcctgacttgagctaattatgaaaatgcagccctccctgatctgagacgttgggaggcaagaataaagtgaaaaagtatatgtaatcccaacatctaattttagtcttagaaactcaaactattaataagtggaaaaagtttaatgatatgcatgtaatgcctttgccatattcctctccttcttagatcacatattcctattttcctgaaaattctgcttttgagaatgctttctgtcccgtaattgtgtatgtctttctttccagctccatgatgcgttatctgggtctggaaacccaaaccctcaaggatggcctggcgcatgggggaaccagcctgctggggcagggggctacccaggggcttcctatcctgcactggcccctatggcgcccctgctgggccactgattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaa

SEQ ID NO: 299010 - DNA, 946 bp, Homo sapiens
  misc_feature (33)..(33): n is a, c, g, or t
ggctacacggtataggtctaggtacgaggctgngtggtggcagcacctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgcattgtgccttataacctgcctttgcctgggggagtggtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaa

SEQ ID NO: 299011 - DNA, 909 bp, Homo sapiens
  misc_feature (33)..(33): n is a, c, g, or t
ggctacacggtataggtctaggtacgaggctgngtggtggcagcacctcctcgccagcagccgtccggagccagccaacgagcggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgctgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaa

SEQ ID NO: 299012 - DNA, 618 bp, Homo sapiens
accctgcggttcatcgtggtgcactgtgtcgtcctgcacctatcgtggtgcactgtgtcgtggtgcactgtgtcgtggtgcactgtgtcgtgttgcactgtgtcgtgcctcgcatgctgataacaattctgggcacggtgaagcccaatgcaaacagaattgctttagatttccaaagagggaatgatgttgccttccactttaacccacgcttcaatgagaacaacaggagagtcattgtttgcaatacaaagctggataataactggggaagggaagaaagacagtcggttttcccatttgaaagtgggaaaccattcaaaatacaagtactggttgaacctgaccacttcaaggttgcagtgaatgatgctcacttgttgcagtacaatcatcgggttaaaaaactcaatgaaatcagcaaactgggaatttctggtgacatagacctcaccagtgcttcatataccatgatataatctgaaaggggcagattaaaaaaaaaaaaagaatctaaaccttacatgtgtaaaggtttcatgttcactgtgagtgaaaatttttacattcatcaatatccctcttgtaagtcatctacttaataaatattacagtgaa

SEQ ID NO: 299013 - DNA, 562 bp, Homo sapiens
aaaccaaatactcagctgcgttaggaattccttctgattcttgctgcaggaaaatggcagacaatttttcgctccatgatgcgttatctgggtctggaaacccaaaccctcaaggatggcctggcgcatgggggaaccagcctgctggggcagggggctacccaggggcttcctatcctggggcctaccccgggcaggcacccccaggggcttatcctggacaggcacctccaggcgcctaccatggagcacctggagcttatcccggagcacctgcacctggagtctacccagggccacccagcggccctggggcctacccatcttctggacagccaagtgcccccggagcctaccctgccactggcccctatggcgcccctgctgggccactgattgtgccttataacctgcctttgcctgggggagtggtgcctcgcatgctgataacaattctgggcacggtgaagcccaatgcaaacaggtaaggagagcaaaattaacaagtctactctatttgtagattggtttttgaataaagaatggcctactttttttcttc

SEQ ID NO: 299014 - DNA, 551 bp, Homo sapiens
tagtcaacatgaatgagtacaaattgggatggccgtagtaatgagatttactgatggctttcttttcaattatttgtacatctagggagccttatctctttggcccctgggcaaagtggcctgagagtctggacagatggcatatactagagttatgtgtttttcacacatattaatagtgatggaactttagcaacatcgttttttccccaaagaaacatgactccttattgacacatatgtacttgttaattcccagaattgtgccttataacctgcctttgcctgggggagtggtgcctcgcatgctgataacaattctgggcacggtgaagcccaatgcaaacaggtaaggagagcaaaattaacaagtctactctatttgtagattggtttttgaataaagaatggcctactttttttcttcttgccctgtcttacagtgctattttgaattttagtaaaattttaaaaactacatatttagaatcttggctataccatcatataggattatcccataaatccatacatattcccatataattttg

SEQ ID NO: 299015 - DNA, 482 bp, Homo sapiens
gagatgtttttgtggcgccacactactgacttaggcataatgcctagagatggattagaactgcacaatgaactagtggtgaggttcagtttaatggaaattggtgaaagcttttaggataaaatgataatctttgtttctttcaggaaaatggcagacaatttttcggtaagtgttttatgcctgtttcttccccttgatcagctccacatggttgagggttgggggttttgtttttaccatgactttcccttttcactctcccactgcgtggcttcccctggactcatttgtccaatgagggcttgcaagctggagccttgtttttccagcagcagatttgggaagaaagccaggcagagcgaggcctgggactcactcacagtaaccctttcaccaaaaggcccagggcggaagggagtggactctgccggcaggagctgagaaatcctctgagtagcgggaagtgcggtacagtctgg

SEQ ID NO: 299016 - DNA, 780 bp, Homo sapiens
ccacgtaattgccacggtaattgccacgtagattgccacttatatcattataaaacaggctggcacagtggcttatgcctgtaatcccaacactttgggaggccaaggcaggtggatcacatgaggtcaggagttcgagaccagcctggccaacatggcaaaactgtctctactaaaaatataaaaattaggtatggtggcacgtgcctgtacttacagctacttgggaggctgaggcatgagatgagaatctcttgaacccaggaggcggaggttgcagtgagctgagattgcaccactgcactccagcttgggtgatggagtgagactcaaataaaaaaggtactagttctgcatttcagagttggcttgttgaaccaggctatatgcttccaagatttaaatgtttttctgtattatactctcaattgtgttttaaaaaaatctcttacagaaatctctacctcaggcactaagtgttatgacatgggtagcatattgatattgaaaacttagctaggacttccagccttttaagataatttaaatgtaaaattaaatggttaaccagcaatctaatgtcatgtggtgtgcagtttggatattgcatgaacagctaaggaatcacctgttctagtgccaaagatcactcattgctaattttgttctgtacagcttatgtaatattttcatggtggagacggactctgtgtgctcagggccttgtctctaggaagattttgtcaattccaaatacagttttgaagattcaaaaaaaat

SEQ ID NO: 299017 - DNA, 3345 bp, Homo sapiens
atcaccatgagttggagcttcctgactcgcctgctagaggagattcacaaccattccacatttgtggggaagatctggctcactgttctgattgtcttccggatcgtccttacagctgtaggaggagaatccatctattacgatgagcaaagcaaatttgtgtgcaacacagaacagccgggctgtgagaatgtctgttatgatgcgtttgcacctctctcccatgtacgcttctgggtgttccagatcatcctggtggcaactccctctgtgatgtacctgggctatgctatccacaagattgccaaaatggagcacggtgaagcagacaagaaggcagctcggagcaagccctatgcaatgcgctggaaacaacaccgggctctggaagaaacggaggaggacaacgaagaggatcctatgatgtatccagagatggagttagaaagtgataaggaaaataaagagcagagccaacccaaacctaagcatgatggccgacgacggattcgggaagatgggctcatgaaaatctatgtgctgcagttgctggcaaggaccgtgtttgaggtgggttttctgatagggcagtattttctgtatggcttccaagtccacccgttttatgtgtgcagcagacttccttgtcctcataagatagactgctttatttctagacccactgaaaagaccatcttccttctgataatgtatggtgttacaggcctttgcctcttgcttaacatttgggagatgcttcatttagggtttgggaccattcgagactcactaaacagtaaaaggagggaacttgaggatccgggtgcttataattatcctttcacttggaatacaccatctgctccccctggctataacattgctgtcaaaccagatcaaatccagtacaccgaactgtccaatgctaagatcgcctacaagcaaaacaaggccaacacagcccaggaacagcagtatggcagccatgaggagaacctcccagctgacctggaggctctgcagcgggagatcaggatggctcaggaacgcttggatctggcagttcaggcctacagtcaccaaaacaaccctcatggtccccgggagaagaaggccaaagtggggtccaaagctgggtccaacaaaagcactgccagtagcaaatcaggggatgggaagacctccgtctggatttaatcctggcgggcttaaaacctgtgcttttcatagtttatggtaagcagcagctcactgaataatgacttccattgagtaaacatttggctctggttatcttcagggatgctgttggctcatgatccaagctcaggggactctggaggcggggctgggctgagggagagaaagggaaacacagtgttcccaggcacatgttcttagcaataatacagttgcagaactttacatttgtgtcttccagatctggagaagaacagacatatttaaatcattcttgttgaacagtttttgtatgtacagtattatggtacttttttttttttagtatgagaactttttttgtatttgtacattgaactgctgtagttatacttttatattaaaggggaaaaagtccttataaataatgcctattaggctagtgctattactttgttcagcaaattctaccctggctttagagtttttaatagatgctacacctaataaaagtgcctctcatattgcaggaacgatttcagatgtgtaaggagactgaagaggagataccagtttttagtcttggaaagcaagttcacagtagaaggaggttgagatctttcttttatgtgagaaatctttgaatctcattcatgcgatcagagttgtagccaatttttgaaaaccttattttcaaaggaaataaatgattcactgtaggattcctttaaatatcaagcatcaccagtatatgctttgatggtatatgtatataacttaaagttctttcaaaagcctgatacagaaacgtgtccccagtttggtagcaatgtggaaaacctggctagagatgatatggagctgtccctcagaaagcaaagccatgcctggaatccctaataggctgcttagttgtgaacctgtttgatttgccttaagcctctatccagaaacctgcccgcttccgtctggttaagaagccagtggtggatattttctttgttaacattagaaatgcaaacattcccttgtcaaccaagaatactcaaagctacttgtattggaaatggcagaaggcctaaatccaaatttcttattttttataatttaccatagaagttttgtgattaaattcttacttctgccagtggaggtttatgcctgaaaggtcatggggtcctgtctgtaaatagacctaaagagaagtgcagtatttattctttgtaggcataatgtgtttgtcactgacaagcattcatgttcatcccactagtcttttattgcagtcttttattgtcattttcagccttatgttggagagctttgctttctcatcatgttcacattgtcttaagttttgtgagcttctgagaaagagcttggtaaaggtttaaaggggactttgttccaccagggagcattttatttgggcgtctcacccttttctaatgaaagctgttgtaagccacctctgacttggaaattctgaaagtatgaatattttttatatcttaattgtaaaatgccagttctccattatttagatgaatagtagaacactgcaccctttgtgcagtgtttttgtttctctactgcattcctacccccaccaaaaaaaagaaacttaaggaaatttttttttgagacagggtctccctctttcacccaggctgagattgcaccactgcactccagcttgggtgatggagtgagactcaaataaaaaaggtactagttctgcatttcagagttggcttgttgaaccaggctatatgcttccaagatttaaatgtttttctgtattatactctcaattgtgttttaaaaaaatctcttacagaaatctctacctcaggcactaagtgttatgacatgggtagcatattgatattgaaaacttagctaggacttccagccttttaagataatttaaatgtaaaattaaatggttaaccagcaatctaatgtcatgtggtgtgcagtttggatattgcatgaacagctaaggaatcacctgttctagtgccaaagatcactcattgctaattttgttctgtacagcttatgtaatattttcatggtggagacggactctgtgtgctcagggccttgtctctaggaagattttgtcaattccaaatacagttttgaagattcaaaaaaaat

SEQ ID NO: 299018 - DNA, 4489 bp, Homo sapiens
atcaccatgagttggagcttcctgactcgcctgctagaggagattcacaaccattccacatttgtggggaagatctggctcactgttctgattgtcttccggatcgtccttacagctgtaggaggagaatccatctattacgatgagcaaagcaaatttgtgtgcaacacagaacagccgggctgtgagaatgtctgttatgatgcgtttgcacctctctcccatgtacgcttctgggtgttccagatcatcctggtggcaactccctctgtgatgtacctgggctatgctatccacaagattgccaaaatggagcacggtgaagcagacaagaaggcagctcggagcaagccctatgcaatgcgctggaaacaacaccgggctctggaagaaacggaggaggacaacgaagaggatcctatgatgtatccagagatggagttagaaagtgataaggaaaataaagagcagagccaacccaaacctaagcatgatggccgacgacggattcgggaagatgggctcatgaaaatctatgtgctgcagttgctggcaaggaccgtgtttgaggtgggttttctgatagggcagtattttctgtatggcttccaagtccacccgttttatgtgtgcagcagacttccttgtcctcataagatagactgctttatttctagacccactgaaaagaccatcttccttctgataatgtatggtgttacaggcctttgcctcttgcttaacatttgggagatgcttcatttagggtttgggaccattcgagactcactaaacagtaaaaggagggaacttgaggatccgggtgcttataattatcctttcacttggaatacaccatctgctccccctggctataacattgctgtcaaaccagatcaaatccagtacaccgaactgtccaatgctaagatcgcctacaagcaaaacaaggccaacacagcccaggaacagcagtatggcagccatgaggagaacctcccagctgacctggaggctctgcagcgggagatcaggatggctcaggaacgcttggatctggcagttcaggcctacagtcaccaaaacaaccctcatggtccccgggagaagaaggccaaagtggggtccaaagctgggtccaacaaaagcactgccagtagcaaatcaggggatgggaagacctccgtctggatttaatcctggcgggcttaaaacctgtgcttttcatagtttatggtaagcagcagctcactgaataatgacttccattgagtaaacatttggctctggttatcttcagggatgctgttggctcatgatccaagctcaggggactctggaggcggggctgggctgagggagagaaagggaaacacagtgttcccaggcacatgttcttagcaataatacagttgcagaactttacatttgtgtcttccagatctggagaagaacagacatatttaaatcattcttgttgaacagtttttgtatgtacagtattatggtacttttttttttttagtatgagaactttttttgtatttgtacattgaactgctgtagttatacttttatattaaaggggaaaaagtccttataaataatgcctattaggctagtgctattactttgttcagcaaattctaccctggctttagagtttttaatagatgctacacctaataaaagtgcctctcatattgcaggaacgatttcagatgtgtaaggagactgaagaggagataccagtttttagtcttggaaagcaagttcacagtagaaggaggttgagatctttcttttatgtgagaaatctttgaatctcattcatgcgatcagagttgtagccaatttttgaaaaccttattttcaaaggaaataaatgattcactgtaggattcctttaaatatcaagcatcaccagtatatgctttgatggtatatgtatataacttaaagttctttcaaaagcctgatacagaaacgtgtccccagtttggtagcaatgtggaaaacctggctagagatgatatggagctgtccctcagaaagcaaagccatgcctggaatccctaataggctgcttagttgtgaacctgtttgatttgccttaagcctctatccagaaacctgcccgcttccgtctggttaagaagccagtggtggatattttctttgttaacattagaaatgcaaacattcccttgtcaaccaagaatactcaaagctacttgtattggaaatggcagaaggcctaaatccaaatttcttattttttataatttaccatagaagttttgtgattaaattcttacttctgccagtggaggtttatgcctgaaaggtcatggggtcctgtctgtaaatagacctaaagagaagtgcagtatttattctttgtaggcataatgtgtttgtcactgacaagcattcatgttcatcccactagtcttttattgcagtcttttattgtcattttcagccttatgttggagagctttgctttctcatcatgttcacattgtcttaagttttgtgagcttctgagaaagagcttggtaaaggtttaaaggggactttgttccaccagggagcattttatttgggcgtctcacccttttctaatgaaagctgttgtaagccacctctgacttggaaattctgaaagtatgaatattttttatatcttaattgtaaaatgccagttctccattatttagatgaatagtagaacactgcaccctttgtgcagtgtttttgtttctctactgcattcctacccccaccaaaaaaaagaaacttaaggaaatttttttttgagacagggtctccctctttcacccagggctggagtgcagcagcatgatctcagctcactgcagcctctgcctcccaggctcaagcaatcattccacctcagcctcttgattagctgggactacaggcatgtgccaccatactcggctaattctgttttaaaaattttttttgtagagatgaggtctcactatgttacccaggctggtctcgaacttttgggttcaagtgatcctcccgcctcagcctctcaaagtgttagtattataggtgtgagccaccatgcccagcctagaaaatttaaccttatcttttagccattcatttacttttatttgcttttttaaaaaaaaatctttaaattttagcctagagaagcacctcaggaactctaaacatcttaggcaaaaattaaactcaggtgagactgaaggagaaatttcagaaatacacatgtacctcatgggtaattaatagacatgcacagtttccttcaaatcaaatgtttaataaggaaattcatataattccaagaaaacaggcaaaatttggaatacataagcctagctaagataaagaactaccagttaattcttaacatcactggagcttccagcaggttttttaattgaaggacaaaaagtgtccatacatttgtgttatctcttcagagcctgagggagaagagagtggctttgccctgtggaaaggctggggatttgagaatgatacagggggaaggagtcaagcagaaatgccaggaagaaccaggcaaagacatttggcgccagaagcatccacttaatttctgtgaagagtgcccctggtgtttcatcttggcctgttttgatgagaatgttatcttttgtgtctggataacgcgtcagcttcttaaagtacatataaagatattctgtcacctccccacatgcacacacttttaaaatctatttttattctcttgctaaagttgtaattatgtcaagaattttccagctctaactgccttcttagtacatgtctttctgcctttgaagcatatgagtttgccaaagtcattctcccctaatgacatattgtggacttacattaagaaaatgggccaggcgcggtggctcacacctgtaatcccagcactttgggaggcccaggcgggtggattacctgaggtcaggagttcaagaccagactggtcaacatggtgaaactccatctctactaaaaatacagaaattagccaggagtgctgggtggacgcctgcaatcccagctacttgggaggttgaggcaggagaattgcttgaacccaggaggcagaggttgcagtgagctgagatcataccattgcactccagcctgcaagacagagtgaaactcttgtctcaaaaaaaaaagaaaaaaagaaagtgagcctgttgatgtctagctaacccattggtggagtctgcattgaatctgtaagaatattgttctggatcatgcaggtgggatttgtataaaaagcctgtccaacatttagttctcactcgcatcagaatcatactgttttgaattgccatataagacatgctccatcatgacacttgcttctcctcccgccacctgtgtgttcttttgatacatttatcttctgtttttctcaaataaagttcaaaggcaaccacctgtt

SEQ ID NO: 299019 - DNA, 3997 bp, Homo sapiens
atcaccatgagttggagcttcctgactcgcctgctagaggagattcacaaccattccacatttgtggggaagatctggctcactgttctgattgtcttccggatcgtccttacagctgtaggaggagaatccatctattacgatgagcaaagcaaatttgtgtgcaacacagaacagccgggctgtgagaatgtctgttatgatgcgtttgcacctctctcccatgtacgcttctgggtgttccagatcatcctggtggcaactccctctgtgatgtacctgggctatgctatccacaagattgccaaaatggagcacggtgaagcagacaagaaggcagctcggagcaagccctatgcaatgcgctggaaacaacaccgggctctggaagaaacggaggaggacaacgaagaggatcctatgatgtatccagagatggagttagaaagtgataaggaaaataaagagcagagccaacccaaacctaagcatgatggccgacgacggattcgggaagatgggctcatgaaaatctatgtgctgcagttgctggcaaggaccgtgtttgaggtgggttttctgatagggcagtattttctgtatggcttccaagtccacccgttttatgtgtgcagcagacttccttgtcctcataagatagactgctttatttctagacccactgaaaagaccatcttccttctgataatgtatggtgttacaggcctttgcctcttgcttaacatttgggagatgcttcatttagggtttgggaccattcgagactcactaaacagtaaaaggagggaacttgaggatccgggtgcttataattatcctttcacttggaatacaccatctgctccccctggctataacattgctgtcaaaccagatcaaatccagtacaccgaactgtccaatgctaagatcgcctacaagcaaaacaaggccaacacagcccaggaacagcagtatggcagccatgaggagaacctcccagctgacctggaggctctgcagcgggagatcaggatggctcaggaacgcttggatctggcagttcaggcctacagtcaccaaaacaaccctcatggtccccgggagaagaaggccaaagtggggtccaaagctgggtccaacaaaagcactgccagtagcaaatcaggggatgggaagacctccgtctggatttaatcctggcgggcttaaaacctgtgcttttcatagtttatggtaagcagcagctcactgaataatgacttccattgagtaaacatttggctctggttatcttcagggatgctgttggctcatgatccaagctcaggggactctggaggcggggctgggctgagggagagaaagggaaacacagtgttcccaggcacatgttcttagcaataatacagttgcagaactttacatttgtgtcttccagatctggagaagaacagacatatttaaatcattcttgttgaacagtttttgtatgtacagtattatggtacttttttttttttagtatgagaactttttttgtatttgtacattgaactgctgtagttatacttttatattaaaggggaaaaagtccttataaataatgcctattaggctagtgctattactttgttcagcaaattctaccctggctttagagtttttaatagatgctacacctaataaaagtgcctctcatattgcaggaacgatttcagatgtgtaaggagactgaagaggagataccagtttttagtcttggaaagcaagttcacagtagaaggaggttgagatctttcttttatgtgagaaatctttgaatctcattcatgcgatcagagttgtagccaatttttgaaaaccttattttcaaaggaaataaatgattcactgtaggattcctttaaatatcaagcatcaccagtatatgctttgatggtatatgtatataacttaaagttctttcaaaagcctgatacagaaacgtgtccccagtttggtagcaatgtggaaaacctggctagagatgatatggagctgtccctcagaaagcaaagccatgcctggaatccctaataggctgcttagttgtgaacctgtttgatttgccttaagcctctatccagaaacctgcccgcttccgtctggttaagaagccagtggtggatattttctttgttaacattagaaatgcaaacattcccttgtcaaccaagaatactcaaagctacttgtattggaaatggcagaaggcctaaatccaaatttcttattttttataatttaccatagaagttttgtgattaaattcttacttctgccagtggaggtttatgcctgaaaggtcatggggtcctgtctgtaaatagacctaaagagaagtgcagtatttattctttgtaggcataatgtgtttgtcactgacaagcattcatgttcatcccactagtcttttattgcagtcttttattgtcattttcagccttatgttggagagctttgctttctcatcatgttcacattgtcttaagttttgtgagcttctgagaaagagcttggtaaaggtttaaaggggactttgttccaccagggagcattttatttgggcgtctcacccttttctaatgaaagctgttgtaagccacctctgacttggaaattctgaaagtatgaatattttttatatcttaattgtaaaatgccagttctccattatttagatgaatagtagaacactgcaccctttgtgcagtgtttttgtttctctactgcattcctacccccaccaaaaaaaagaaacttaaggaaatttttttttgagacagggtctccctctttcacccagggctggagtgcagcagcatgatctcagctcactgcagcctctgcctcccaggctcaagcaatcattccacctcagcctcttgattagctgggactacaggcatgtgccaccatactcggctaattctgttttaaaaattttttttgtagagatgaggtctcactatgttacccaggctggtctcgaacttttgggttcaagtgatcctcccgcctcagcctctcaaagtgttagtattataggtgtgagccaccatgcccagcctagaaaatttaaccttatcttttagccattcatttacttttatttgcttttttaaaaaaaaatctttaaattttagcctagagaagcacctcaggaactctaaacatcttaggcaaaaattaaactcaggtgagactgaaggagaaatttcagaaatacacatgtacctcatgggtaattaatagacatgcacagtttccttcaaatcaaatgtttaataaggaaattcatataattccaagaaaacaggcaaaatttggaatacataagcctagctaagataaagaactaccagttaattcttaacatcactggagcttccagcaggttttttaattgaaggacaaaaagtgtccatacatttgtgttatctcttcagagcctgagggagaagagagtggctttgccctgtggaaaggctggggatttgagaatgatacagggggaaggagtcaagcagaaatgccaggaagaaccaggcaaagacatttggcgccagaagcatccacttaatttctgtgaagagtgcccctggtgtttcatcttggcctgttttgatgagaatgttatcttttgtgtctggataacgcgtcagcttcttaaagtacatataaagatattctgtcacctccccacatgcacacacttttaaaatctatttttattctcttgctaaagttgtaattatgtcaagaattttccagctctaactgccttcttagtacatgtctttctgcctttgaagcatatgagtttgccaaagtcattctcccctaatgacatattgtggacttacattaagaaaatgggccaccatgcccagcctagaaaatttaaccttatcttttagccattcatttacttttatttgcttttttaaaaaaa

SEQ ID NO: 299020 - DNA, 2351 bp, Homo sapiens
aaaagaccttcaaggaccaaccattattattggtcacttgtttgaacttggcgcttaaaaaaaaagttggactgtgatgctttggtgctctttatcacagacatcagtgatggtctgaaacactctctagcagtttatacgaagaatggacttacatgttatcagttacactcatgatttactcgttcagcttctacaagtccatactttatgctgtctcatttaagagacagtccacttctgaaaataaaatcgatagttgatgatacatttttggctagccagctttctgtaaaaggcaagtatgttagacatgcacagtttccttcaaatcaaatgtttaataaggtacttcaagaaacgcctttttaaaaatcaaaggttttggccaggcatggtggctcacgcctgtaatcccagcactttgggaggccaaggtgggcgaatcacaaggtcaggagtttgagaccagcctggccaacatggtgaaaccccgtctctactaaaaataccaaaaattagccgggcgtggtggtgggtacctgtaatcccagctactcaggaggctgagatgagaatcacttgatcccaggaggtagaggttgcagtgagccgagattgcgccattgcacttcagcctgggcaacgagtgaaactctcaaaaaaaaattcatagtaataataaagtccctgcatgcagtttggaaataaaatttaaactcatttatgtgtaataaatatgtaataattcacagtcaccatcaaatgttggaatcattgaattgcatacttgtactcattccggccacatcatgaagtgtttaaagatttgtatttgctgttgtccctatgtagttctattgatgtttggtttgttttttggggtttgttttgagcccaggctagagtgcaatggcacaatctcaactcactacagcctggacctccttggctcaagcagtcctcccacttcagcctcccaagtagctggtctgcaggtgctcaccaccacacctggctaattttgtatttttgtagagacagagctctcactatgttgcctagactggtctcaaactcctgggcccaagcaatcctcccatcacagcctccgaaggtgctgggattacaggcataagccactgtgcccagcctgtttttaataatgatattaagtgggttggttcatgtgttattaatcagtgttaataatcgtacttttttttttttttaaaagaaaccatggtattctaaaatcaggagtccaaataaaagaaagttctcggctgtgcgtggtggctaacacctgtaatcccagcactttgggaggctgaggtgggtggatcactagaggtcaggagtttggaaacaagcctggccaacatggtaaaaccccctctctactaaaaatacaaaaattagccgggcatggtggtgcacacctgtaatcccagctactcgggatgttgaggcatgagatttccttgaacctggaaggcagaggttgctgtgagccgagatcgcgccactgcactccagcctgggtgacagagtaagactgtcgccaaaaaagaggaaaaaagttatccagtgcagtttctacagagataaaagaagtaatagttctggctgggtgtggtggcttatgcctgtaatcccaacactttgggaggccaaggcaggtggatcacatgaggtcaggagttcgagaccagcctggccaacatggcaaaactgtctctactaaaaatataaaaattaggtatggtggcacgtgcctgtacttacagctacttgggaggctgaggcatgagatgagaatctcttgaacccaggaggcggaggttgcagtgagctgagattgcaccactgcactccagcttgggtgatggagtgagactcaaataaaaaaggtactagttctgcatttcagagttggcttgttgaaccaggctatatgcttccaagatttaaatgtttttctgtattatactctcaattgtgttttaaaaaaatctcttacagaaatctctacctcaggcactaagtgttatgacatgggtagcatattgatattgaaaacttagctaggacttccagccttttaagataatttaaatgtaaaattaaatggttaaccagcaatctaatgtcatgtggtgtgcagtttggatattgcatgaacagctaaggaatcacctgttctagtgccaaagatcactcattgctaattttgttctgtacagcttatgtaatattttcatggtggagacggactctgtgtgctcagggccttgtctctaggaagattttgtcaattccaaatacagttttgaagattcaaaaaaaat

SEQ ID NO: 299021 - DNA, 2188 bp, Homo sapiens
atcaccatgagttggagcttcctgactcgcctgctagaggagattcacaaccattccacatttgtggggaagatctggctcactgttctgattgtcttccggatcgtccttacagctgtaggaggagaatccatctattacgatgagcaaagcaaatttgtgtgcaacacagaacagccgggctgtgagaatgtctgttatgatgcgtttgcacctctctcccatgtacgcttctgggtgttccagatcatcctggtggcaactccctctgtgatgtacctgggctatgctatccacaagattgccaaaatggagcacggtgaagcagacaagaaggcagctcggagcaagccctatgcaatgcgctggaaacaacaccgggctctggaagctactcaggaggctgagatgagaatcacttgatcccaggaggtagaggttgcagtgagccgagattgcgccattgcacttcagcctgggcaacgagtgaaactctcaaaaaaaaattcatagtaataataaagtccctgcatgcagtttggaaataaaatttaaactcatttatgtgtaataaatatgtaataattcacagtcaccatcaaatgttggaatcattgaattgcatacttgtactcattccggccacatcatgaagtgtttaaagatttgtatttgctgttgtccctatgtagttctattgatgtttggtttgttttttggggtttgttttgagcccaggctagagtgcaatggcacaatctcaactcactacagcctggacctccttggctcaagcagtcctcccacttcagcctcccaagtagctggtctgcaggtgctcaccaccacacctggctaattttgtatttttgtagagacagagctctcactatgttgcctagactggtctcaaactcctgggcccaagcaatcctcccatcacagcctccgaaggtgctgggattacaggcataagccactgtgcccagcctgtttttaataatgatattaagtgggttggttcatgtgttattaatcagtgttaataatcgtacttttttttttttttaaaagaaaccatggtattctaaaatcaggagtccaaataaaagaaagttctcggctgtgcgtggtggctaacacctgtaatcccagcactttgggaggctgaggtgggtggatcactagaggtcaggagtttggaaacaagcctggccaacatggtaaaaccccctctctactaaaaatacaaaaattagccgggcatggtggtgcacacctgtaatcccagctactcgggatgttgaggcatgagatttccttgaacctggaaggcagaggttgctgtgagccgagatcgcgccactgcactccagcctgggtgacagagtaagactgtcgccaaaaaagaggaaaaaagttatccagtgcagtttctacagagataaaagaagtaatagttctggctgggtgtggtggcttatgcctgtaatcccaacactttgggaggccaaggcaggtggatcacatgaggtcaggagttcgagaccagcctggccaacatggcaaaactgtctctactaaaaatataaaaattaggtatggtggcacgtgcctgtacttacagctacttgggaggctgaggcatgagatgagaatctcttgaacccaggaggcggaggttgcagtgagctgagattgcaccactgcactccagcttgggtgatggagtgagactcaaataaaaaaggtactagttctgcatttcagagttggcttgttgaaccaggctatatgcttccaagatttaaatgtttttctgtattatactctcaattgtgttttaaaaaaatctcttacagaaatctctacctcaggcactaagtgttatgacatgggtagcatattgatattgaaaacttagctaggacttccagccttttaagataatttaaatgtaaaattaaatggttaaccagcaatctaatgtcatgtggtgtgcagtttggatattgcatgaacagctaaggaatcacctgttctagtgccaaagatcactcattgctaattttgttctgtacagcttatgtaatattttcatggtggagacggactctgtgtgctcagggccttgtctctaggaagattttgtcaattccaaatacagttttgaagattcaaaaaaaat

SEQ ID NO: 299022 - DNA, 1615 bp, Homo sapiens
atcaccatgagttggagcttcctgactcgcctgctagaggagattcacaaccattccacatttgtggggaagatctggctcactgttctgattgtcttccggatcgtccttacagctgtaggaggagaatccatctattacgatgagcaaagcaaatttgtgtgcaacacagaacagccgggctgtgagaatgtctgttatgatgcgtttgcacctctctcccatgtacgcttctgggtgttccagatcatcctggtggcaactccctctgtgatgtacctgggctatgctatccacaagattgccaaaatggagcacggtgaagcagacaagaaggcagctcggagcaagccctatgcaatgcgctggaaacaacaccgggctctggaagctactcaggaggctgagatgagaatcacttgatcccaggaggtagaggttgcagtgagccgagattgcgccattgcacttcagcctgggcaacgagtgaaactctcaaaaaaaaattcatagtaataataaagtccctgcatgcagtttggaaataaaatttaaactcatttatgtgtaataaatatgtaataattcacagtcaccatcaaatgttggaatcattgaattgcatacttgtactcattccggccaacatggtaaaaccccctctctactaaaaatacaaaaattagccgggcatggtggtgcacacctgtaatcccagctactcgggatgttgaggcatgagatttccttgaacctggaaggcagaggttgctgtgagccgagatcgcgccactgcactccagcctgggtgacagagtaagactgtcgccaaaaaagaggaaaaaagttatccagtgcagtttctacagagataaaagaagtaatagttctggctgggtgtggtggcttatgcctgtaatcccaacactttgggaggccaaggcaggtggatcacatgaggtcaggagttcgagaccagcctggccaacatggcaaaactgtctctactaaaaatataaaaattaggtatggtggcacgtgcctgtacttacagctacttgggaggctgaggcatgagatgagaatctcttgaacccaggaggcggaggttgcagtgagctgagattgcaccactgcactccagcttgggtgatggagtgagactcaaataaaaaaggtactagttctgcatttcagagttggcttgttgaaccaggctatatgcttccaagatttaaatgtttttctgtattatactctcaattgtgttttaaaaaaatctcttacagaaatctctacctcaggcactaagtgttatgacatgggtagcatattgatattgaaaacttagctaggacttccagccttttaagataatttaaatgtaaaattaaatggttaaccagcaatctaatgtcatgtggtgtgcagtttggatattgcatgaacagctaaggaatcacctgttctagtgccaaagatcactcattgctaattttgttctgtacagcttatgtaatattttcatggtggagacggactctgtgtgctcagggccttgtctctaggaagattttgtcaattccaaatacagttttgaagattcaaaaaaaat

SEQ ID NO: 299023 - DNA, 3484 bp, Homo sapiens
accgcctcttgtttttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggtatctgtgggtttgtgcactcggtgacctgtcacctccatcgtgccctcatggcagggtaagtgtgagggaacagggtctggaggcagactggccagggtttctgacttggatctgccactcagacttctgggtaagtcacgtgacttgagtgctccggtttcttcatctgtttagcggggctcataaagccactcccttgatgctgggaatccagtgagaccagggagtggggaagcgcttctcaaagtgtgtgattttgatccgcctcacctgttccccagtaacttattggggggctgcgagccgtggtgcggcggtcagactgcctggattcatggaccctctccatgccttagtttccttatctgtaagcaggctgatactagaacctgcttcacagggttgtgcttagggtcagtgagcagctgttagtgaggggaatgtagtggccaccaggcaggaactaggactccagccagttctttcctggtgggccacgtgtaactgtgtggccttgggcgagacatttcacttttctgtgcctgagtttatcagtaaactggagatggggggattcctcaccctgagttgtgaggattgaatgacagaaggcactagtgacagtgatgctggaggaaggagtgttgccaagtgcctcggtcactttgcctaatttcagaaagtcactctgagttggtatgttttgtgtttttaaaaaagctaggattcataaaattaaatagaaatcagtgaaataaaatatttgatatttaaaatacatttagaaatacaaagtgtcaagcaaaacgtgaatttggaaatctatggaacattagataaggtatttaaaagtaattgccatgtaaaaatgacacgaacttgaagtaagattatttgatttttctaaaaatacaagaaagcttggtgcaaaaaaaagg

SEQ ID NO: 299024 - DNA, 3498 bp, Homo sapiens
  misc_feature (19)..(19): n is a, c, g, or t
caactgcatcgttgccgtncccgggataaggtagcgaggctcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggtatctgtgggtttgtgcactcggtgacctgtcacctccatcgtgccctcatggcagggtaagtgtgagggaacagggtctggaggcagactggccagggtttctgacttggatctgccactcagacttctgggtaagtcacgtgacttgagtgctccggtttcttcatctgtttagcggggctcataaagccactcccttgatgctgggaatccagtgagaccagggagtggggaagcgcttctcaaagtgtgtgattttgatccgcctcacctgttccccagtaacttattggggggctgcgagccgtggtgcggcggtcagactgcctggattcatggaccctctccatgccttagtttccttatctgtaagcaggctgatactagaacctgcttcacagggttgtgcttagggtcagtgagcagctgttagtgaggggaatgtagtggccaccaggcaggaactaggactccagccagttctttcctggtgggccacgtgtaactgtgtggccttgggcgagacatttcacttttctgtgcctgagtttatcagtaaactggagatggggggattcctcaccctgagttgtgaggattgaatgacagaaggcactagtgacagtgatgctggaggaaggagtgttgccaagtgcctcggtcactttgcctaatttcagaaagtcactctgagttggtatgttttgtgtttttaaaaaagctaggattcataaaattaaatagaaatcagtgaaataaaatatttgatatttaaaatacatttagaaatacaaagtgtcaagcaaaacgtgaatttggaaatctatggaacattagataaggtatttaaaagtaattgccatgtaaaaatgacacgaacttgaagtaagattatttgatttttctaaaaatacaagaaagcttggtgcaaaaaaaagg

SEQ ID NO: 299025 - DNA, 3458 bp, Homo sapiens
aaggctaggtacgaggcctgggtgttgctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggtatctgtgggtttgtgcactcggtgacctgtcacctccatcgtgccctcatggcagggtaagtgtgagggaacagggtctggaggcagactggccagggtttctgacttggatctgccactcagacttctgggtaagtcacgtgacttgagtgctccggtttcttcatctgtttagcggggctcataaagccactcccttgatgctgggaatccagtgagaccagggagtggggaagcgcttctcaaagtgtgtgattttgatccgcctcacctgttccccagtaacttattggggggctgcgagccgtggtgcggcggtcagactgcctggattcatggaccctctccatgccttagtttccttatctgtaagcaggctgatactagaacctgcttcacagggttgtgcttagggtcagtgagcagctgttagtgaggggaatgtagtggccaccaggcaggaactaggactccagccagttctttcctggtgggccacgtgtaactgtgtggccttgggcgagacatttcacttttctgtgcctgagtttatcagtaaactggagatggggggattcctcaccctgagttgtgaggattgaatgacagaaggcactagtgacagtgatgctggaggaaggagtgttgccaagtgcctcggtcactttgcctaatttcagaaagtcactctgagttggtatgttttgtgtttttaaaaaagctaggattcataaaattaaatagaaatcagtgaaataaaatatttgatatttaaaatacatttagaaatacaaagtgtcaagcaaaacgtgaatttggaaatctatggaacattagataaggtatttaaaagtaattgccatgtaaaaatgacacgaacttgaagtaagattatttgatttttctaaaaatacaagaaagcttggtgcaaaaaaaagg

SEQ ID NO: 299026 - DNA, 2645 bp, Homo sapiens
accgcctcttgtttttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaatataagcccgggggtcaggtcacaccccacaaaaattcggggcctttcgcggggacaaggttagggcacgtgcaagtccgccccttttccagggaatccgcccaaggcatataaggcaccccaga

SEQ ID NO: 299027 - DNA, 3457 bp, Homo sapiens
aggggaggaggtgccaggcgctgcccccagcctgttctggccgtttgttcccaccccaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggtatctgtgggtttgtgcactcggtgacctgtcacctccatcgtgccctcatggcagggtaagtgtgagggaacagggtctggaggcagactggccagggtttctgacttggatctgccactcagacttctgggtaagtcacgtgacttgagtgctccggtttcttcatctgtttagcggggctcataaagccactcccttgatgctgggaatccagtgagaccagggagtggggaagcgcttctcaaagtgtgtgattttgatccgcctcacctgttccccagtaacttattggggggctgcgagccgtggtgcggcggtcagactgcctggattcatggaccctctccatgccttagtttccttatctgtaagcaggctgatactagaacctgcttcacagggttgtgcttagggtcagtgagcagctgttagtgaggggaatgtagtggccaccaggcaggaactaggactccagccagttctttcctggtgggccacgtgtaactgtgtggccttgggcgagacatttcacttttctgtgcctgagtttatcagtaaactggagatggggggattcctcaccctgagttgtgaggattgaatgacagaaggcactagtgacagtgatgctggaggaaggagtgttgccaagtgcctcggtcactttgcctaatttcagaaagtcactctgagttggtatgttttgtgtttttaaaaaagctaggattcataaaattaaatagaaatcagtgaaataaaatatttgatatttaaaatacatttagaaatacaaagtgtcaagcaaaacgtgaatttggaaatctatggaacattagataaggtatttaaaagtaattgccatgtaaaaatgacacgaacttgaagtaagattatttgatttttctaaaaatacaagaaagcttggtgcaaaaaaaagg

SEQ ID NO: 299028 - DNA, 3580 bp, Homo sapiens
accgcctcttgtttttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagtcttgcaccttcattgattgagcacctgctgcctgccagatactgttctgggtgctgggctgcagcactgaagctggacctggctcctgcttctagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggtatctgtgggtttgtgcactcggtgacctgtcacctccatcgtgccctcatggcagggtaagtgtgagggaacagggtctggaggcagactggccagggtttctgacttggatctgccactcagacttctgggtaagtcacgtgacttgagtgctccggtttcttcatctgtttagcggggctcataaagccactcccttgatgctgggaatccagtgagaccagggagtggggaagcgcttctcaaagtgtgtgattttgatccgcctcacctgttccccagtaacttattggggggctgcgagccgtggtgcggcggtcagactgcctggattcatggaccctctccatgccttagtttccttatctgtaagcaggctgatactagaacctgcttcacagggttgtgcttagggtcagtgagcagctgttagtgaggggaatgtagtggccaccaggcaggaactaggactccagccagttctttcctggtgggccacgtgtaactgtgtggccttgggcgagacatttcacttttctgtgcctgagtttatcagtaaactggagatggggggattcctcaccctgagttgtgaggattgaatgacagaaggcactagtgacagtgatgctggaggaaggagtgttgccaagtgcctcggtcactttgcctaatttcagaaagtcactctgagttggtatgttttgtgtttttaaaaaagctaggattcataaaattaaatagaaatcagtgaaataaaatatttgatatttaaaatacatttagaaatacaaagtgtcaagcaaaacgtgaatttggaaatctatggaacattagataaggtatttaaaagtaattgccatgtaaaaatgacacgaacttgaagtaagattatttgatttttctaaaaatacaagaaagcttggtgcaaaaaaaagg

SEQ ID NO: 299029 - DNA, 3316 bp, Homo sapiens
accgcctcttgtttttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagtacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggtatctgtgggtttgtgcactcggtgacctgtcacctccatcgtgccctcatggcagggtaagtgtgagggaacagggtctggaggcagactggccagggtttctgacttggatctgccactcagacttctgggtaagtcacgtgacttgagtgctccggtttcttcatctgtttagcggggctcataaagccactcccttgatgctgggaatccagtgagaccagggagtggggaagcgcttctcaaagtgtgtgattttgatccgcctcacctgttccccagtaacttattggggggctgcgagccgtggtgcggcggtcagactgcctggattcatggaccctctccatgccttagtttccttatctgtaagcaggctgatactagaacctgcttcacagggttgtgcttagggtcagtgagcagctgttagtgaggggaatgtagtggccaccaggcaggaactaggactccagccagttctttcctggtgggccacgtgtaactgtgtggccttgggcgagacatttcacttttctgtgcctgagtttatcagtaaactggagatggggggattcctcaccctgagttgtgaggattgaatgacagaaggcactagtgacagtgatgctggaggaaggagtgttgccaagtgcctcggtcactttgcctaatttcagaaagtcactctgagttggtatgttttgtgtttttaaaaaagctaggattcataaaattaaatagaaatcagtgaaataaaatatttgatatttaaaatacatttagaaatacaaagtgtcaagcaaaacgtgaatttggaaatctatggaacattagataaggtatttaaaagtaattgccatgtaaaaatgacacgaacttgaagtaagattatttgatttttctaaaaatacaagaaagcttggtgcaaaaaaaagg

SEQ ID NO: 299030 - DNA, 2436 bp, Homo sapiens
accgcctcttgtttttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagggggccctccttccagaaacaccctgcctgcttctggtggtataatagaggacactcagcatggcaccctctcactttatgcctggtgatgggcctgatctgtcgggtcagtgcctttccccagaaggaacgtggtggcatttgttgattcatccgtttgtgtcatggagataatgaccgtacctacaataaagggcgaggtgagcattaaatgcatgaatgtatgcagagctcttaga

SEQ ID NO: 299031 - DNA, 3042 bp, Homo sapiens
accgcctcttgtttttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagcccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggtatctgtgggtttgtgcactcggtgacctgtcacctccatcgtgccctcatggcagggtaagtgtgagggaacagggtctggaggcagactggccagggtttctgacttggatctgccactcagacttctgggtaagtcacgtgacttgagtgctccggtttcttcatctgtttagcggggctcataaagccactcccttgatgctgggaatccagtgagaccagggagtggggaagcgcttctcaaagtgtgtgattttgatccgcctcacctgttccccagtaacttattggggggctgcgagccgtggtgcggcggtcagactgcctggattcatggaccctctccatgccttagtttccttatctgtaagcaggctgatactagaacctgcttcacagggttgtgcttagggtcagtgagcagctgttagtgaggggaatgtagtggccaccaggcaggaactaggactccagccagttctttcctggtgggccacgtgtaactgtgtggccttgggcgagacatttcacttttctgtgcctgagtttatcagtaaactggagatggggggattcctcaccctgagttgtgaggattgaatgacagaaggcactagtgacagtgatgctggaggaaggagtgttgccaagtgcctcggtcactttgcctaatttcagaaagtcactctgagttggtatgttttgtgtttttaaaaaagctaggattcataaaattaaatagaaatcagtgaaataaaatatttgatatttaaaatacatttagaaatacaaagtgtcaagcaaaacgtgaatttggaaatctatggaacattagataaggtatttaaaagtaattgccatgtaaaaatgacacgaacttgaagtaagattatttgatttttctaaaaatacaagaaagcttggtgcaaaaaaaagg

SEQ ID NO: 299032 - DNA, 2171 bp, Homo sapiens
accgcctcttgtttttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgtgctcagacacctgggagccaatggcaaagcggcgcttgagctgcttctcgatgcggctca

SEQ ID NO: 299033 - DNA, 3006 bp, Homo sapiens
cacacagtgagctgacagcagacacgtggagatggggcttttggagggctctgtgggctggcactaagcctcctaaaccagcgtacaaatgagttagcgagttcagcgagagtcaggccaccacctgcctttctgtttggctgtcactgtgggcaacaccatcctccaagcagctgagcatgggctgagtgacgtggggagagaggccgttctctgggctccgtggggctggagccagctcagcatgtggtgcctgtggcaaaaatgctgcagtggaccctgcgtgtcctgggcatgggtggaatcagagacttgctgtccaagtcagaatctcagcttttctcctttctcctctaccctcctctcaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggctccctgatggacttactcgccgaggagacatcaacctgctgatgctaggggaccctgggacagccaagtcccagcttctgaagtttgtggagaagtgttctcccattggggtatacacgtctgggaaaggcagcagcgcagctggactgacagcctcggtgatgagggacccttcgtcccggaatttcatcatggagggcggagccatggtcctggccgatggtggggtcgtctgtattgacgagtttgacaagatgcgagaagatgaccgtgtggcaatccacgaagccatggagcagcagaccatctctatcgccaaggctgggatcaccaccaccctgaactcccgctgctccgtcctggctgctgccaactcagtgttcggccgctgggatgagacgaagggggaggacaacattgacttcatgcccaccatcttgtcgcgcttcgacatgatcttcatcgtcaaggatgagcacaatgaggagagggatgtgatgctggccaagcatgtcatcactctgcacgtgagcgcactgacacagacacaggctgtggagggcgagattgacctggccaagctgaagaagtttattgcctactgccgagtgaagtgtggcccccggctgtcagcagaggctgcagagaaactgaagaaccgctacatcatcatgcggagcggggcccgtcagcacgagagggacagtgaccgccgctccagcatccccatcactgtgcggcagctggaggccattgtgcgcatcgcggaagccctcagcaagatgaagctgcagcccttcgccacagaggcagatgtggaggaggccctgcggctcttccaagtgtccacgttggatgctgccttgtccggtaccctgtcaggggtggagggcttcaccagccaggaggaccaggagatgctgagccgcatcgagaagcagctcaagcgccgctttgccattggctcccaggtgtctgagcacagcatcatcaaggacttcaccaagcagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggtatctgtgggtttgtgcactcggtgacctgtcacctccatcgtgccctcatggcagggtaagtgtgagggaacagggtctggaggcagactggccagggtttctgacttggatctgccactcagacttctgggtaagtcacgtgacttgagtgctccggtttcttcatctgtttagcggggctcataaagccactcccttgatgctgggaatccagtgagaccagggagtggggaagcgcttctcaaagtgtgtgattttgatccgcctcacctgttccccagtaacttattggggggctgcgagccgtggtgcggcggtcagactgcctggattcatggaccctctccatgccttagtttccttatctgtaagcaggctgatactagaacctgcttcacagggttgtgcttagggtcagtgagcagctgttagtgaggggaatgtagtggccaccaggcaggaactaggactccagccagttctttcctggtgggccacgtgtaactgtgtggccttgggcgagacatttcacttttctgtgcctgagtttatcagtaaactggagatggggggattcctcaccctgagttgtgaggattgaatgacagaaggcactagtgacagtgatgctggaggaaggagtgttgccaagtgcctcggtcactttgcctaatttcagaaagtcactctgagttggtatgttttgtgtttttaaaaaagctaggattcataaaattaaatagaaatcagtgaaataaaatatttgatatttaaaatacatttagaaatacaaagtgtcaagcaaaacgtgaatttggaaatctatggaacattagataaggtatttaaaagtaattgccatgtaaaaatgacacgaacttgaagtaagattatttgatttttctaaaaatacaagaaagcttggtgcaaaaaaaagg

SEQ ID NO: 299034 - DNA, 1482 bp, Homo sapiens
  misc_feature (1200)..(1200): n is a, c, g, or t
  misc_feature (1203)..(1203): n is a, c, g, or t
  misc_feature (1232)..(1232): n is a, c, g, or t
  misc_feature (1261)..(1261): n is a, c, g, or t
accgcctcttgtttttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacagatcaggctgggcgccccaaatgcccattggacccgtacttcatcatgcccgacaaatgcaaatgcgtggacttccagaccctgaagctgcaggagctgcctgatgcagtcccccacggggagatgcccagacacatgcagctctactgcgacaggtacctgtgtgacaaggtcgtccctgggaacagggttaccatcatgggcatctactccatcaagaagtttggcctgactaccagcaggggccgtgacagggtgggcgtgggcatccgaagctcctacatccgtgtcctgggcatccaggtggacacagatggctctggccgcagctttgctggggccgtgagcccccaggaggaggaggagttccgtcgcctggctgccctcccaaatgtctatgaggtcatctccaagagcatcgccccctccatctttgggggcacagacatgaagaaggccattgcctgcctgctctttgggggctcccgaaagaggtcctgatggattantcngcgaggagaatcaactgtgatgctagggnacctggaagcagtccagtctgagttgggngaggtccccttgggtttccgtctgggaaaggcgcgccgcgtgacggcgctctgtgatgggacctcggcccgattctcctggggcggccctgccgccagtggggcctgtttgcttgccaacgcgcgagtcctggtccccgggccctttccggggacccccccgtccgggcccccgcggacggggctccctcctttcacgggctttccgctagcggtccgcct

SEQ ID NO: 299035 - DNA, 847 bp, Homo sapiens
accgcctcttgtttttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacgatcaggctgggccccaaatgccttgggccgattcatctggcccgaatgcattgcggtggcttccgacctgactgaggagtgctggtgcgcccccggggggatgccgaacttgtgcctttgacgccgtggagggccgggggggcaccgggcccccag

SEQ ID NO: 299036 - DNA, 1605 bp, Homo sapiens
gattcagggcagtttaatgggtggtatcgtgtctattctataggtgcgcagactgaggcttagagaaaggtttagagcttcggttctagagtcagatgggacttaagtccagctctacctcttaattgctgtgaccttgagcaagtggcttagctccgtgtgcctcagtgtctggtacacagtgggcactcaggaagtgtgggccctttaggtcaaaggagcctgagtacaaagttccccgtgagcctggggatgtctgggctctgtcggagtcccctcgggcagcacgtgccgttagccagccatgtgctcccacagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggtatctgtgggtttgtgcactcggtgacctgtcacctccatcgtgccctcatggcagggtaagtgtgagggaacagggtctggaggcagactggccagggtttctgacttggatctgccactcagacttctgggtaagtcacgtgacttgagtgctccggtttcttcatctgtttagcggggctcataaagccactcccttgatgctgggaatccagtgagaccagggagtggggaagcgcttctcaaagtgtgtgattttgatccgcctcacctgttccccagtaacttattggggggctgcgagccgtggtgcggcggtcagactgcctggattcatggaccctctccatgccttagtttccttatctgtaagcaggctgatactagaacctgcttcacagggttgtgcttagggtcagtgagcagctgttagtgaggggaatgtagtggccaccaggcaggaactaggactccagccagttctttcctggtgggccacgtgtaactgtgtggccttgggcgagacatttcacttttctgtgcctgagtttatcagtaaactggagatggggggattcctcaccctgagttgtgaggattgaatgacagaaggcactagtgacagtgatgctggaggaaggagtgttgccaagtgcctcggtcactttgcctaatttcagaaagtcactctgagttggtatgttttgtgtttttaaaaaagctaggattcataaaattaaatagaaatcagtgaaataaaatatttgatatttaaaatacatttagaaatacaaagtgtcaagcaaaacgtgaatttggaaatctatggaacattagataaggtatttaaaagtaattgccatgtaaaaatgacacgaacttgaagtaagattatttgatttttctaaaaatacaagaaagcttggtgcaaaaaaaagg

SEQ ID NO: 299037 - DNA, 1403 bp, Homo sapiens
cttttctagccatcattccttccctagggacatcttcatcaggagcagggatgggggtattttttctgtcccacgaaggggaggggagagcagaggtggttggattctggtgaaacaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggtatctgtgggtttgtgcactcggtgacctgtcacctccatcgtgccctcatggcagggtaagtgtgagggaacagggtctggaggcagactggccagggtttctgacttggatctgccactcagacttctgggtaagtcacgtgacttgagtgctccggtttcttcatctgtttagcggggctcataaagccactcccttgatgctgggaatccagtgagaccagggagtggggaagcgcttctcaaagtgtgtgattttgatccgcctcacctgttccccagtaacttattggggggctgcgagccgtggtgcggcggtcagactgcctggattcatggaccctctccatgccttagtttccttatctgtaagcaggctgatactagaacctgcttcacagggttgtgcttagggtcagtgagcagctgttagtgaggggaatgtagtggccaccaggcaggaactaggactccagccagttctttcctggtgggccacgtgtaactgtgtggccttgggcgagacatttcacttttctgtgcctgagtttatcagtaaactggagatggggggattcctcaccctgagttgtgaggattgaatgacagaaggcactagtgacagtgatgctggaggaaggagtgttgccaagtgcctcggtcactttgcctaatttcagaaagtcactctgagttggtatgttttgtgtttttaaaaaagctaggattcataaaattaaatagaaatcagtgaaataaaatatttgatatttaaaatacatttagaaatacaaagtgtcaagcaaaacgtgaatttggaaatctatggaacattagataaggtatttaaaagtaattgccatgtaaaaatgacacgaacttgaagtaagattatttgatttttctaaaaatacaagaaagcttggtgcaaaaaaaagg

SEQ ID NO: 299038 - DNA, 1396 bp, Homo sapiens
tttccccgttggcgggcgtttcatggagtgggaaggggcagagccatgagagtgagctttctggctcactgaggagggtactgttggccccagccatgtgctcccacagaaatacccggagcacgccatccacaaggtgctgcagctcatgctgcggcgcggcgagatccagcatcgcatgcagcgcaaggttctctaccgcctcaagtgagtcgcgccgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggtatctgtgggtttgtgcactcggtgacctgtcacctccatcgtgccctcatggcagggtaagtgtgagggaacagggtctggaggcagactggccagggtttctgacttggatctgccactcagacttctgggtaagtcacgtgacttgagtgctccggtttcttcatctgtttagcggggctcataaagccactcccttgatgctgggaatccagtgagaccagggagtggggaagcgcttctcaaagtgtgtgattttgatccgcctcacctgttccccagtaacttattggggggctgcgagccgtggtgcggcggtcagactgcctggattcatggaccctctccatgccttagtttccttatctgtaagcaggctgatactagaacctgcttcacagggttgtgcttagggtcagtgagcagctgttagtgaggggaatgtagtggccaccaggcaggaactaggactccagccagttctttcctggtgggccacgtgtaactgtgtggccttgggcgagacatttcacttttctgtgcctgagtttatcagtaaactggagatggggggattcctcaccctgagttgtgaggattgaatgacagaaggcactagtgacagtgatgctggaggaaggagtgttgccaagtgcctcggtcactttgcctaatttcagaaagtcactctgagttggtatgttttgtgtttttaaaaaagctaggattcataaaattaaatagaaatcagtgaaataaaatatttgatatttaaaatacatttagaaatacaaagtgtcaagcaaaacgtgaatttggaaatctatggaacattagataaggtatttaaaagtaattgccatgtaaaaatgacacgaacttgaagtaagattatttgatttttctaaaaatacaagaaagcttggtgcaaaaaaaagg

SEQ ID NO: 299039 - DNA, 705 bp, Homo sapiens
accgcctcttgtttttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacagggatgaactcaagcggcattacaacctgggggagtactggattgaggtggagatggaggatctggccagctttgatgaggacctggccgactacttgtacaagcagccagccgagcacctgcagctgctggaggaagctgccaaggaggtagctgatgaggtgacccggccccggccttctggggaggaggtgctccaggacatccaggtcatgctcaagtcggacgccagcccttccagcattcgtagcctgaagtcggacatgatgtcacacctggtgaagatccctggcatcatcatcgcggcctctgcggtccgtgccaaggccacccgtcctggcccgcacatccgtactggcccgctttctgccttggccatggtgaggagacccacacagaaaaccaagatgtggccaagagacgccattgtccacatccgtactgg

SEQ ID NO: 299040 - DNA, 1403 bp, Homo sapiens
gggctgctttttgaatgagacaggtgtgttcctgcctctgtgactttgtgcttggcctggagtgtccccacatgtgccatatcctgtctcctcaatcaggcctgcaccaccctggcacactcggtgcccttttctgacttactcttcggggcctggctcaggctgttcttccttgggctagaggctgtctctgtccaagaactcccattgtcccagctccccggctgcctcactggactcatggactcgcccacgcctcgcccctcctgccgctgcctgccattgacaatgttgctgggacctctgcctccccactgcagccctcgaacttcccaggcaccctcctttctgccccagaggaaggagctgtagtgtcctgctgcctctgggcgcccgcctctagcgcggttctgggaagtgtgcttttggcatccgttaataataaagccacggtgtgttcaggtatctgtgggtttgtgcactcggtgacctgtcacctccatcgtgccctcatggcagggtaagtgtgagggaacagggtctggaggcagactggccagggtttctgacttggatctgccactcagacttctgggtaagtcacgtgacttgagtgctccggtttcttcatctgtttagcggggctcataaagccactcccttgatgctgggaatccagtgagaccagggagtggggaagcgcttctcaaagtgtgtgattttgatccgcctcacctgttccccagtaacttattggggggctgcgagccgtggtgcggcggtcagactgcctggattcatggaccctctccatgccttagtttccttatctgtaagcaggctgatactagaacctgcttcacagggttgtgcttagggtcagtgagcagctgttagtgaggggaatgtagtggccaccaggcaggaactaggactccagccagttctttcctggtgggccacgtgtaactgtgtggccttgggcgagacatttcacttttctgtgcctgagtttatcagtaaactggagatggggggattcctcaccctgagttgtgaggattgaatgacagaaggcactagtgacagtgatgctggaggaaggagtgttgccaagtgcctcggtcactttgcctaatttcagaaagtcactctgagttggtatgttttgtgtttttaaaaaagctaggattcataaaattaaatagaaatcagtgaaataaaatatttgatatttaaaatacatttagaaatacaaagtgtcaagcaaaacgtgaatttggaaatctatggaacattagataaggtatttaaaagtaattgccatgtaaaaatgacacgaacttgaagtaagattatttgatttttctaaaaatacaagaaagcttggtgcaaaaaaaagg

SEQ ID NO: 299041 - DNA, 833 bp, Homo sapiens
agttgagtccaggaattcaagaccagcctgggaaatatagcaagactcccttctccacaaaaaaagaaaaaaataggcaaaggacttgaatagaaatttctcgactgagtgtggtggctcacacctgtaatcccagcactttgggaggctaaggcaggtggatcacctgcggtcaggagttcgaaaccagcctggccaacatggtgaaacccatctctactaaaaatacaaaaattagccgggcatggtgacacgtgcatgtaatcccagctactcgggaggctgaggcaggagaatcgcttgaacccgggaggcagaggttgcagtgagctgagagcgcgccactgcacttcagcctgggcaacaagagcaagactccatctaaaggaaaaagaaaaagaaaaaaaaaattcccaaaaagaaatggccaataagcacatgaaaagatattcaacattgttagtcattaggaaaatgcaaatcaaaaacacaatgagaaaccactttacatccacaagagtgggtataataaaagaagtgttggccaggtgcagtgtaatcccctcatgcctgtaatccccaaactttgggaggctgaggcaggtggatcacctgaggtcgagacttcgagaccagcctgaccaacatggagaaacccctctctcctaaaaatacaaaattagccgggcatggtggtacatgtctgtaatcccaggtacttgggagactgaggcaggagaatcacttgaacctgggaggcagaggttgcagggagccaagatcatgccactacactccagcctgggtaacaagagcgaaactctgtcttaaaa

SEQ ID NO: 299042 - DNA, 323 bp, Homo sapiens
tactactactactactaatttcgcggccgcgtcgaccctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgaggttccgtcgacgcggccgcgaat

SEQ ID NO: 299043 - DNA, 395 bp, Homo sapiens
tgaccagagtagcatagagaggcccggcgcggtggctcacgcctgtaatcccagcactttgagaggccgaggcgggcagatcacctgaggtcaggagttcgagaccagcctggccaatatagtgaaaccccgtctctactaaaaatataaaaattaaccctgtgtggtggcatgctcctgtaatcccagctaccaggaggcagaggttgcagtgagccaagatcgcactactgcactactgcactccagcctgggtgacagagcaagacactgtctcaaaaacaaacaaacaaaaaacagagtagcatagaagagaccttcccctccctgagtctggactttatacctttgttaataggatgctgtcacacacacacacactgaaccgcctggag

SEQ ID NO: 299044 - DNA, 1827 bp, Homo sapiens
ctccccccactcaagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacgggacagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagcca

SEQ ID NO: 299045 - DNA, 2290 bp, Homo sapiens
  misc_feature (2028)..(2028): n is a, c, g, or t
  misc_feature (2172)..(2172): n is a, c, g, or t
  misc_feature (2274)..(2274): n is a, c, g, or t
ctccccccactcaagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacgggacagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagccaaattttctgcctgagaacttgggtccctatcaaagttccttcttcatccccagagacccccgagggagccaggcctctgcttacataccccacctacgggatactcactgccacccaaggatgcagggccccaggggcccagacagcaacagagctcagagaccacccgctccccacgctgttcccagatgagcccctgantcgccagccagtgactcaaacaagcccctccctccacccttagggtacccttgggtcagcctctcaaagacccccttgcagactagctctgaaaggtcaagtcctttgcccaagctcacaggtaggtcacagaccaggcctgtntctgcagtcctttcttaagtccggtagattgcccacctttgtggtccctggatccttccttgggacagtggagggagtgggctgaaatcccacagacttccnaagggttagcctgggg

SEQ ID NO: 299046 - DNA, 2423 bp, Homo sapiens
ctccccccactcaagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacgggacagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagccaaattttctgcctgagaacttgggtccctatcaaagttccttcttcatccccagagacccccgagggagccaggcctctgcttacataccccacctacgggatagccactgcacttcagcctgggcaacaagagcaagactccatctaaaggaaaaagaaaaagaaaaaaaaaattcccaaaaagaaatggccaataagcacatgaaaagatattcaacattgttagtcattaggaaaatgcaaatcaaaaacacaatgagaaaccactttacatccacaagagtgggtataataaaagaagtgttggccaggtgcagtgtaatcccctcatgcctgtaatccccaaactttgggaggctgaggcaggtggatcacctgaggtcgagacttcgagaccagcctgaccaacatggagaaacccctctctcctaaaaatacaaaattagccgggcatggtggtacatgtctgtaatcccaggtacttgggagactgaggcaggagaatcacttgaacctgggaggcagaggttgcagggagccaagatcatgccactacactccagcctgggtaacaagagcgaaactctgtcttaaaa

SEQ ID NO: 299047 - DNA, 1944 bp, Homo sapiens
ctccccccactcaagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagaggatctgctccgtcacccaggctggagtgcagtggtgtgatcacagctcactgcagcctcaaactcctgggctcaaccagtcctctcacctcagcctcctgagtagccgggattacagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacgggacagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagcca

SEQ ID NO: 299048 - DNA, 1670 bp, Homo sapiens
ctccccccactcaagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacgggacagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagcca

SEQ ID NO: 299049 - DNA, 1676 bp, Homo sapiens
gtgacctgggagcagcagaaatctggaaactgacagcatggacgtgctggccgcagcttccaggatctgctccgtcacccaggctggagtgcagtggtgtgatcacagctcactgcagcctcaaactcctgggctcaaccagtcctctcacctcagcctcctgagtagccgggattacagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacgggacagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagcca

SEQ ID NO: 299050 - DNA, 1702 bp, Homo sapiens
ctccccccactcaagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccagacctcccagctaactggaacctgtgtccacagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacgggacagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagcca

SEQ ID NO: 299051 - DNA, 1793 bp, Homo sapiens
ctccccccactcaagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacgggacagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagcca

SEQ ID NO: 299052 - DNA, 1653 bp, Homo sapiens
ctccccccactcaagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacgggacagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagcca

SEQ ID NO: 299053 - DNA, 1886 bp, Homo sapiens
ctccccccactcaagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagggagaaggtgatggggacaaggatgaggcttgaaggagcagctagacatctggaggaagagtgctccgggcagaaggcccagcaggtgcaaaggccctgaggctggaacaggcatggatctgctccgtcacccaggctggagtgcagtggtgtgatcacagctcactgcagcctcaaactcctgggctcaaccagtcctctcacctcagcctcctgagtagccgggattacagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacgggacagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagcca

SEQ ID NO: 299054 - DNA, 1454 bp, Homo sapiens
agctgtgctctctgagcctgtaactttgcccctccgagacttggttatcccaccggcagcatgtctgcccccacacacaggcagtcccatctcttcacctgggctgataggctctgtctcctttgcacccagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacgggacagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagcca

SEQ ID NO: 299055 - DNA, 1977 bp, Homo sapiens
ctccccccactcaagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagctggaggtttctcttctacctgtcctccttcgtgggcggcctctcggtcctgtaccacgagtcatggctgtgggcaccagtaatgtgctgggacaggtacccaaaccagactctgaagccatccctgtactggtggtacctcttggagctgggtttctacctctcactgctaatcaggctgccctttgatgtcaagcgcaaggatttcaaggagcaggtgatacaccacttcgtggcggtcatcctgatgaccttctcctacagtgccaacctgctgcgcattggctctctggtgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccaccggacgtgatggtgcatacctgtaatcccagctactcgggaggctgaggcaggaggatcacttaaacccagaaggcagaggctacagcgaatcaagattgtaccactgcactccagcctggccaacatggcaaaaaccacctctctactaaaaatacaaaaattagctgggcgtggtggcaggggcctataatcccagctacttgggaggctgaggcaggagaatcgctggaacctgggaggcagaggttgcagtgagccgagatcacgccattgcactccagcctgggtgacagagcaagactccatctcaaaaaaaaaaaaaaaaaaaacagagtagcatagaagagaccttcccctccctgagtctggactttatacctttgttaataggatgctgtcacacacacgcacactgaaccgcctggagctcagctcagctttccctccctaccccctcctggactcccagagacagattttaatccagggtcccatgacactgtgtctgaagagtgatcattacctatcagctatgccctggggaccccttctgccctgtgcctggccccactttcctcccacccctgtctgtctgtctgtctgtcatttgttcattcagcacagacttaggaagtgtctgcagtgggaggcactggggacagacagccacaggaagccttacggagctgatgtccccgcaaggagaaggtaatggggacaaggatgaggcttgaaggagcagctagacatctggaggaagagtgctccgggcagaaggccagcaggtgcaaggc

SEQ ID NO: 299056 - DNA, 1004 bp, Homo sapiens
tcccagctactcgggaggctgaggcaggaagatggcttgagcccaggagatcgaggctgcagtgagctatgattgcaccgctgcattccagcctggaagacagagtgagagattgcctccctgcagaaaatgtagtctcttagcaattttccagtatatactatattattaactaaaatcatcatgatgtacagatctcttggacttactactgctgctgttacacgattcctctgactacctgctggaggcctgtaagatggtcaactacatgcagtatcagcaagtgtgcgacgctctcttcctcatcttctcctttgtcttcttctacacccgactggtcctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacgggacagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagcca

SEQ ID NO: 299057 - DNA, 984 bp, Homo sapiens
tgagaagaggatgtggtgggagctgggctccaggacagtgtcccaggcaacaagcaaggaggagttcgagggaaggagcagtgctggggaacattctttccaactggcttgggttgcacagtgaaaatgaagccccgcccctcccagcctccgtgggagacaaagccccacctctgtccggctacctgggagatgaggccccaccccttttttactccttgggagatgaggccccgcccctcttaaactctgggagatggagccctgctccctgtgtcttcctgggagatgaggccccaccgcctgccttcctgacatgaagcccctcccctatgaggatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacgggacagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagcca

SEQ ID NO: 299058 - DNA, 767 bp, Homo sapiens
tgccgaggctctcctcaccagccacccagggagtcacctccctcagcctcccgcctgccccacacggaggctctggctgtcctctttctccactccatttgcttggctctttcccacccagatcctctacaccacatactacgagtccatcagcaacaggggccccttcttcggctactacttcttcaacgggcttctgatgttgctgcagctgctgcacgtgttctggtcttgcctcattctgcgcatgctctatagcttcatgaagaagggccagatggagaaggacattcgtagtgatgtagaagaatcagactccagtgaggaggcggcggcggcccaggaacctctgcagctaaagaacgggacagctggagggcccaggccagcccccactgatggccctcggagccgggtggccgggcgtctgaccaacaggcacacaacagccacatagccgggcggggctggctgtaaggggttgcccccccgccagtgccttggatatttctggggtgactggactggcgcccctgggccacctttctggagacagggagggccccacccggggtgggtgggaaggctgatgatctgtctccagccccttccttctgcccacccacccttcttccctctgggcaactggacagatctgggagccagcagctggatgctgtggctggccagagacacctccaggctgtggcctgggggctggggggagccccaggctgaaaagggtccaattaaaacaaatggagcca

SEQ ID NO: 299059 - DNA, 881 bp, Homo sapiens
ctccccccactcaagccttttttcccctgctgggggccgaggcccggccaggagcagagtccggctgcctggggcgggcggcgcgtgtctgcagctgctccgggtagcccgctaggcgcgccgtccccagccccgccgccggccctcggtgcgcccggccgcctgcacccccaggagcagctgctgtgaataaacacagaagtggagctgggggactgattagaagcctcattcagtgcacctgggccccagcaggcccagccaggcgtggaggaagaggcattgaggactttccttacctgtttttccagctcacccactgccagcagagaatgctgtccagtttcaacgagtggttttggcaggacaggttctggttaccacccaatgtcacgtggacagagctagaagaccgggatggccgtgtctacccccacccccaggacttgttggcagccctgcccctggcgctggtcctcctggccatgcgccttgcctttgagagattcattggcctgcccctgagccggtggctgggtgtgagggatcagaccaggaggcaagtgaagcccaacgccacgctggagaaacacttcctcacggaagggcacaggcccaaggagccccagctgtctctcctggccgcccagtgtggcctcacgctgcagcagacccagcgatggttccggagacgccggaaccaggatcgaccccagctgaccaagaagttctgtgaggccagcctgacgttctctttctacatgtcctccttcgtgggccggcctctcggttctggtaccacgagtcatggctgtgggcaccagttaatgtgctgggcacacggttaccaaaccaaactctggatgccctcctttactcgg

SEQ ID NO: 299060 - DNA, 210 bp, Homo sapiens
aggacagttccaaagtcccaggcaaggggagttccatcttccagtcctgcctcctggttgtcaactgcgctgataggggcccgagtaggagttctgaggctccagcctctcaggccccacttgccccacccattctgcttgcagacctcccagctaactggaacctgtgtccacagaatgctgtccagtttcaacgagtggttttggcag

SEQ ID NO: 299061 - DNA, 562 bp, Homo sapiens
tgcagctgaggagagagcgagctttgcaagatggtggtgaatgttcactcaacaggtatttggatttactatgcaccaaaagttggggttctgcagtgaatgagccccccagtcgagagtgagaagcaggaaaaagcagggctgggtgaaggtagcatctatgtgactgtggaaggagaaccaaagagaccgcagacccagggtgggaggttggattctcacctctgcacagcctgacacccatttccctgcaggagtcatggctgtgggcaccagtaatgtgctgggacaggtacccaaaccaggtgagtggcagagtgtgtgtgaatgcttggagggtgagggcgatgatcacagttgctgcagccatgggcatgggacccgaaccctgacactacactgtcattccccactgagtcccacgctctttgattcctctggggaatagagaggggccagaaaaccaagcaggagcttccaccaaaccactgcccttgattacctccagggatggggagctcactcattgggattcaagtatcctggttttgagcaaacggag

SEQ ID NO: 299062 - DNA, 1257 bp, Homo sapiens
tcctgggctccgctgtgtttttctattctggggtgtaaggggcagctggaccactccagctgggactgctaggaaggttgcgggtccacccggccgagccgaacgagggaaatggtcctcacccggccactcgccggttgaaaaggggccgccctggcagggaagcggccgccgcggcgcggtgcagcgcagcggcgagaaggagtgcgttatcgtcttgcgctactgctgaatgtccgtcccggaggaggaggagaggcttttgccgctgacccagagatggccccgagcgagcaaattcctactgtccggctgcgcggctaccgtggccgagctaggtacccggctgcccacgcctgggcctcccgggccagtggcacgcgccgcgctgggggagggtgcgcgggcggcttcgcgcccggcagtgcgcatcggagaggtcgccccttccatgcccgcctggcagaggtggcggtggaggccaggcccgcggtgggaggaggagggattgaggtctccacggccttttccttctaatctcttctaatgcttcccttaggcatgtgctgtggtgcttgaatgttgtactttaagaagcttcgcgagctgtcattcctctgtaggaatcattttccttttcatgaggatgacctttttaaaaacgtaatctgttttccatccttactgagatcatctctgtggtttatagtcttacacagccacactgtcattatcttgtgggtccaagttgtggacctaccttgtgggacttccgttattaacctgccactcacagagcatcgactacttgacctctttgagtgtaattcatctatactgtttaccttgcaggattctgagaagtcaataatatatgattgctaaacccaaggcaggacacccattagttgcgacatttttataattcctacaataccagggactgtggatatatatttgaaaagacccagttctgaccttcttacaggctgctggggagacagagaaagacaattataatgtgctacttgttataatgaagatattattaggtgtcataaaagcatagaagagcagttacatctgcctacatgagtaagaaaaaactttaagaggccatctagagtggaatgatgatgcccttgaatgagcaagtagcgtttattccaaggattttgtgagtagtatactcatgtgtttcctgtgaagccttaactgtgtattttaagattacccttacattttcttgcctgttac

SEQ ID NO: 299063 - DNA, 2076 bp, Homo sapiens
tcctgggctccgctgtgtttttctattctggggtgtaaggggcagctggaccactccagctgggactgctaggaaggttgcgggtccacccggccgagccgaacgagggaaatggtcctcacccggccactcgccggttgaaaaggggccgccctggcagggaagcggccgccgcggcgcggtgcagcgcagcggcgagaaggagtgcgttatcgtcttgcgctactgctgaatgtccgtcccggaggaggaggagaggcttttgccgctgacccagagatggccccgagcgagcaaattcctactgtccggctgcgcggctaccgtggccgagctagcaacctttcccctggatctcacaaaaactcgactccaaatgcaaggagaagcagctcttgctcggttgggagacggtgcaagagaatctgccccctataggggaatggtgcgcacagccctagggatcattgaagaggaaggctttctaaagctttggcaaggagtgacacccgccatttacagacacgtagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgaccccttggtcaatggtgttctggcttacttatgaaaaaatcagagagatgagtggagtcagtccattttaaacccctaaagatgcaacccttaaagatacagtgttcagtattattgaaatatgggcatctgcaacacataccccctattatttctacctctttaggaagacacctattccacagagactgatttatagggggcagcactttatttttttctggaaacccaagttctctttgactcctctttttgtccaaaagtgatctggtcggatctcacaaggccatccaatgagaccccgcacagcattttctaaagaagaatcgaagcctgaccactttcaccttgggcaagaagaaaggtaagagttcttcaaattcagctacataccaccggctctcccaacctcagacggtgggcatttctggatggatggctgcggttatggataaaggctgtaactgttaacacagaaaaacatgaaaagctcaggcccaagaaaggccttggagccagccaaacagaatttgttctaatggacatggatgatgttgaacagaaaaaagtttacaagtgctttgtggttgcactaatgtatactcactgccattttaagagggggaagtacattttaaaatatatttgaatgtcatgtactgatatgcagtagcttattgtttttctagttgcagagaatgtgaagtttaatctcttaaaatatttagatggtctactttttcattgaatttgtcaatatgtaattgcgttgtaaaatatatatatatatatatatatatatatatatatatatatgcttaacttcccaagtgttctgcattgaaccacttagggaaaattttgtttgtttttatgttttgtaatttttaaaattaagtaaagactggatcaaaataattgcatccaacctggaccgtgaaaa

SEQ ID NO: 299064 - DNA, 2051 bp, Homo sapiens
tcctgggctccgctgtgtttttctattctggggtgtaaggggcagctggaccactccagctgggactgctaggaaggttgcgggtccacccggccgagccgaacgagggaaatggtcctcacccggccactcgccggttgaaaaggggccgccctggcagggaagcggccgccgcggcgcggtgcagcgcagcggcgagaaggagtgcgttatcgtcttgcgctactgctgaatgtccgtcccggaggaggaggagaggcttttgccgctgacccagagatggccccgagcgagcaaattcctactgtccggctgcgcggctaccgtggccgagctagcaacctttcccctggatctcacaaaaactcgactccaaatgcaaggagaagcagctcttgctcggttgggagacggtgcaagagaatctgccccctataggggaatggtgcgcacagccctagggatcattgaagaggaaggctttctaaagctttggcaaggagtgacacccgccatttacagacacgtagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgaccccttggtcaatggtgttctggcttacttatgaaaaaatcagagagatgagtggagtcagtccattttaaacccctaaagatgcaacccttaaagatacagtgttcagtattattgaaatatgggcatctgcaacacataccccctattatttctacctctttaggaagacacctattccacagagactgatttatagggggcagcactttatttttttctggaaacccaagttctctttgactcctctttttgtccaaaagtgatctggtcggatctcacaaggccatccaatgagaccccgcacagcattttctaaagaagaatcgaagcctgaccactttcaccttgggcaagaagaaaggtaagagttcttcaaattcagctacataccaccggctctcccaacctcagacggtgggcatttctggatggatggctgcggttatggataaaggctgtaactgttaacacagaaaaacatgaaaagctcaggcccaagaaaggccttggagccagccaaacagaatttgttctaatggacatggatgatgttgaacagaaaaaagtttacaagtgctttgtggttgcactaatgtatactcactgccattttaagagggggaagtacattttaaaatatatttgaatgtcatgtactgatatgcagtagcttattgtttttctagttgcagagaatgtgaagtttaatctcttaaaatatttagatggtctactttttcattgaatttgtcaatatgtaattgcgttgtaaaatattatatatatatgcttaacttcccaagtgttctgcattgaaccacttagggaaaattttgtttgtttttatgttttgtaatttttaaaattaagtaaagactggatcaaaataattgcatccaacctggaccgtgaaaa

SEQ ID NO: 299065 - DNA, 3023 bp, Homo sapiens
  misc_feature (8)..(8): n is a, c, g, or t
aagagtanaagctactctttcagagagaaaaataggagattcatgtgacaaagatttgcctctgaaattttgtgagttcccacagaagactataatgcctggatttaaaacaactgtatatgtttctcatataaatgacctttcagacttttatgttcaactaatagaagatgaagctgaaattagtcatctttcagagagattaaacagtgttaaaacaaggcccgaatattatgtaggtccacctttgcaaagaggagatatgatatgtgctgttttcccagaagataatttatggtatcgtgctgtgatcaaggagcaacaacccaatgaccttctctctgtgcagtttatagattatggcaatgtttctgtggttcatactaacaaaataggtaggcttgaccttgttaatgcaatattgccggggttgtgcattcattgctccttgcagggatttgaggttcctgacaataaaaattctaagaaaatgatgcattacttttcccaacggaccagcgaggctgcaataagatgtgaatttgttaaatttcaagacagatgggaagttattcttgctgatgaacatgggatcatagcagatgatatgattagcaggtatgctctcagtgaaaaatctcaagtagaactttctacccaagtaattaaaagtgccagttcaaagtctgttaacaaatcagacattgacacttcagtatttcttaactggtataatccagaaaaaaaaatgataagagcttatgccactgtgatagatggacctgagtacttttggtgtcagtttgctgatacggagaaacttcagtgtttagaagtagaagtacagactgctggagaacaggtagcagacaggagaaattgtatcccatgtccttatattggagatccttgtatagtaagatacagagaagatggacattattatagggcacttatcactaatatttgtgaagattatcttgtatctgtcaggcttgtggactttggaaacattgaagactgtgtggacccaaaagcactctgggccattccttctgaacttctgtcggttcccatgcaagcctttccatgttgcctctcagggtttaacatttcagaaggattatgttctcaagagggaaatgactatttctatgaaataataacagaagatgtgttggaaataacaatactagaaatcagaagggatgtttgtgatatccctttagcaattgttgacttgaaaagcaaaggtaaaagtattaatgagaaaatggagaaatattctaagactggtattaaaagtgctcttccctatgaaaatattgactcagagataaagcagactcttgggtcctacaatcttgatgtaggacttaagaaattaagtaataaagctgtacaaaataaaatatatatggaacaacagacagatgagcttgctgaaataactgaaaaagatgtaaacattattggaaccaaaccaagtaacttccgtgaccctaaaactgataacatttgtgaagggtttgaaaacccctgcaaagataaaattgatactgaggaactggaaggtgaattagagtgccatctggttgacaaagcagagtttgatgataaatacctgattacaggatttaacacattactaccacatgctaatgaaacaaaggagatactagaactgaattcacttgaggtgccgctttctcctgatgatgaatcaaaagaattcttagaactggaatctattgagttacagaattctctggtggtggatgaagaaaaaggggagctaagcccggtgccaccgaatgtgccactctcccaagagtgtgtcacaaaaggcgccatggagctatttacactgcagcttcctctcagctgtgaagctgagaaacagccagaactagaactacctacagcccagctgcctttagatgacaagatggatcctttgtctttaggagttagtcagaaagcacaggaatccatgtgtactgaggacatgagaaagtcaagttgtgtagaatcttttgatgaccagcgcaggatgtcattgcatctacatggagcagattgtgatcctaaaacacagaatgaaatgaatatatgtgaagaagaatttgtagagtataaaaacagggatgccatttcggcattgatgcctttgttctctgaggaagaaagcagtgatggaagcaagcacaataatggtttaccagatcatatctcagctcaactacagaacacctacactctgaaagcctttactgttggatctaaatgtgttgtgtggtcaagtctaagaaacacatggtctaaatgtgagattttagaaacagctgaagaaggaacaagggttttgaacctttcaaatggtatggaggagatagtgaaccctgagaatgtctggaatggcatacccaaattggataagagtccacctgagaaaaggggtttggaggtgatggagatttaaccgtggatctatagctgtggccaatcagtcagaagctgcccttgaacaagtggcatcttacgcagaccaacagagtatttgagaaaattgaaaacatgtaaccacaagaagttgtcattttcaaaaacttctatataggtggaaaacaaattaggtctcaggttgatggtggggtgtgtttatagtgatcctgttatatatacagatctgggatctttcgtctttattgtcttacgtttctaattagttgggaggatttattttgctaaacagtttactaacacattacatttcaaaaactattttggtacctttcaaatacagtgtttaaattaaaatagaaaaataagggctcatgacaagtacattatttgattctacttaggatagctttttagcaggatctccttcagaatttttgtcttgactttgaatctttgcctgtttgtctaaacatttgactaacattctgtttgaatttggaagtattctaatacaagatttgaataaagtttatccttaaataaagtttatccttata

SEQ ID NO: 299066 - DNA, 3348 bp, Homo sapiens
  misc_feature (8)..(8): n is a, c, g, or t
aagagtanaagctactctttcagagagaaaaataggagattcatgtgacaaagatttgcctctgaaattttgtgagttcccacagaagactataatgcctggatttaaaacaactgtatatgtttctcatataaatgacctttcagacttttatgttcaactaatagaagatgaagctgaaattagtcatctttcagagagattaaacagtgttaaaacaaggcccgaatattatgtaggtccacctttgcaaagaggagatatgatatgtgctgttttcccagaagataatttatggtatcgtgctgtgatcaaggagcaacaacccaatgaccttctctctgtgcagtttatagattatggcaatgtttctgtggttcatactaacaaaataggtaggcttgaccttgttaatgcaatattgccggggttgtgcattcattgctccttgcagggatttgaggttcctgacaataaaaattctaagaaaatgatgcattacttttcccaacggaccagcgaggctgcaataagatgtgaatttgttaaatttcaagacagatgggaagttattcttgctgatgaacatgggatcatagcagatgatatgattagcaggtatgctctcagtgaaaaatctcaagtagaactttctacccaagtaattaaaagtgccagttcaaagtctgttaacaaatcagacattgacacttcagtatttcttaactggtataatccagaaaaaaaaatgataagagcttatgccactgtgatagatggacctgagtacttttggtgtcagtttgctgatacggagaaacttcagtgtttagaagtagaagtacagactgctggagaacaggtagcagacaggagaaattgtatcccatgtccttatattggagatccttgtatagtaagatacagagaagatggacattattatagggcacttatcactaatatttgtgaagattatcttgtatctgtcaggcttgtggactttggaaacattgaagactgtgtggacccaaaagcactctgggccattccttctgaacttctgtcggttcccatgcaagcctttccatgttgcctctcagggtttaacatttcagaaggattatgttctcaagagggaaatgactatttctatgaaataataacagaagatgtgttggaaataacaatactagaaatcagaagggatgtttgtgatatccctttagcaattgttgacttgaaaagcaaaggtaaaagtattaatgagaaaatggagaaatattctaagactggtattaaaagtgctcttccctatgaaaatattgactcagagataaagcagactcttgggtcctacaatcttgatgtaggacttaagaaattaagtaataaagctgtacaaaataaaatatatatggaacaacagacagatgagcttgctgaaataactgaaaaagatgtaaacattattggaaccaaaccaagtaacttccgtgaccctaaaactgataacatttgtgaagggtttgaaaacccctgcaaagataaaattgatactgaggaactggaaggtgaattagagtgccatctggttgacaaagcagagtttgatgataaatacctgattacaggatttaacacattactaccacatgctaatgaaacaaaggagatactagaactgaattcacttgaggtgccgctttctcctgatgatgaatcaaaagaattcttagaactggaatctattgagttacagaattctctggtggtggatgaagaaaaaggggagctaagcccggtgccaccgaatgtgccactctcccaagagtgtgtcacaaaaggcgccatggagctatttacactgcagcttcctctcagctgtgaagctgagaaacagccagaactagaactacctacagcccagctgcctttagatgacaagatggatcctttgtctttaggagttagtcagaaagcacaggaatccatgtgtactgaggacatgagaaagtcaagttgtgtagaatcttttgatgaccagcgcaggatgtcattgcatctacatggagcagattgtgatcctaaaacacagaatgaaatgaatatatgtgaagaagaatttgtagagtataaaaacagggatgccatttcggcattgatgcctttgttctctgaggaagaaagcagtgatggaagcaagcacaataatggtttaccagatcatatctcagctcaactacagaacacctacactctgaaagcctttactgttggatctaaatgtgttgtgtggtcaagtctaagaaacacatggtctaaatgtgagattttagaaacagctgaagaaggaacaagggttttgaacctttcaaatggtatggaggagatagtgaaccctgagaatgtctggaatggcatacccaaattggataagagtccacctgagaaaaggggtttggaggtgatggagatttaaccgtggatctatagctgtggccaatcagtcagaagctgcccttgaacaagtggcatcttacgcagaccaacagagtatttgagaaaattgaaaacatgtaaccacaagaagttgtcattttcaaaaacttctatataggtggaaaacaaattaggtctcaggttgatggtggggtgtgtttatagtgatcctgttatatatacagatctgggatctttcgtctttattgtcttacgtttctaattagttgggaggatttattttgctaaacagtttactaacacattacatttcaaaaactattttggtacctttcaaatacagtgtttaaattaaaatagaaaaataagggctcatgacaagtacattatttgattctacttaggatagctttttagcaggatctccttcagaatttttgtcttgactttgaatctttgcctgtttgtctaaacatttgactaacattctgtttgaatttggaagtattctaatacaagatttgaataaagtttatccttaaataaagtttatccttataaaaaaaaaataacaatggcctccttggcctcaccgggggactctgcgggccgtcccttttatgaggccaatgcatgttcctccctcctgactcccgccctcggcgtcccgtcgcggaggcgtccactccttcttggccgactcgggtttccccaattctcggccaaccatgaagatagtgtgccgtaacgccgcatcggcctctactctacccggcactccgctcctattactatcccccgctccttcccaatcccctacctcctctccccatacgtgtatccctccgcattctttttccatcctctccatcacctctcctccct

SEQ ID NO: 299067 - DNA, 1914 bp, Homo sapiens
tcctgggctccgctgtgtttttctattctggggtgtaaggggcagctggaccactccagctgggactgctaggaaggttgcgggtccacccggccgagccgaacgagggaaatggtcctcacccggccactcgccggttgaaaaggggccgccctggcagggaagcggccgccgcggcgcggtgcagcgcagcggcgagaaggagtgcgttatcgtcttgcgctactgctgaatgtccgtcccggaggaggaggagaggcttttgccgctgacccagagatggccccgagcgagcaaattcctactgtccggctgcgcggctaccgtggccgagctagcaacctttcccctggatctcacaaaaactcgactccaaatgcaaggagaagcagctcttgctcggttgggagacggtgcaagagaatctgccccctataggggaatggtgcgcacagccctagggatcattgaagaggaaggctttctaaagctttggcaaggagtgacacccgccatttacagacacgtagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgaccccttggtcaatggtgttctggcttacttatgaaaaaatcagagagatgagtggagtcagtccattttaaacccctaaagatgcaacccttaaagatacagtgttcagtattattgaaatatgggcatctgcaacacataccccctattatttctacctctttaggaagacacctattccacagagactgatttatagggggcagcactttatttttttctggaaacccaagttctctttgactcctctttttgtccaaaagtgatctggtcggatctcacaaggccatccaatgagaccccgcacagcattttctaaagaagaatcgaagcctgaccactttcaccttgggcaagaaggtttggcctttgagttgctattctatgctgaagagcctgcttagaggaggagtaccaggagggagccagcatttcagatctgaagtagacgataggaatgtggaagaacacatacatagtgcttaagaaatacatttaacctgttatgtcagtatttatcaatgaagtttgataattcacttttctgtcattgttaaagcgtacatactgtaaattaaagggaggtgaatggaaattaatgaataaacattttgagtttccctagtgttgaaggaaggtgtactttttcttgtcagaaagataaaaaaaatcaagttgagatgatgtttgaatttcaagaaaagaggctgctttctgtcagtgccctctcattagatctgtgttaattagttagcactccactgcacatgctaatgacttc

SEQ ID NO: 299068 - DNA, 1983 bp, Homo sapiens
tcctgggctccgctgtgtttttctattctggggtgtaaggggcagctggaccactccagctgggactgctaggaaggttgcgggtccacccggccgagccgaacgagggaaatggtcctcacccggccactcgccggttgaaaaggggccgccctggcagggaagcggccgccgcggcgcggtgcagcgcagcggcgagaaggagtgcgttatcgtcttgcgctactgctgaatgtccgtcccggaggaggaggagaggcttttgccgctgacccagagatggccccgagcgagcaaattcctactgtccggctgcgcggctaccgtggccgagctagcaacctttcccctggatctcacaaaaactcgactccaaatgcaaggagaagcagctcttgctcggttgggagacggtgcaagagaatctgccccctataggggaatggtgcgcacagccctagggatcattgaagaggaaggctttctaaagctttggcaaggagtgacacccgccatttacagacacgtagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgaacaggctgctgtgattgtcaacagcagcaggagccagttgaaggtttgataaaagcagatgaagatgcttaaagatgtctgtttgctgaaaatatctttactgttggatctaaatgtgttgtgtggtcaagtctaagaaacacatggtctaaatgtgagattttagaaacagctgaagaaggaacaagggttttgaacctttcaaatggtatggaggagatagtgaaccctgagaatgtctggaatggcatacccaaattggataagagtccacctgagaaaaggggtttggaggtgatggagatttaaccgtggatctatagctgtggccaatcagtcagaagctgcccttgaacaagtggcatcttacgcagaccaacagagtatttgagaaaattgaaaacatgtaaccacaagaagttgtcattttcaaaaacttctatataggtggaaaacaaattaggtctcaggttgatggtggggtgtgtttatagtgatcctgttatatatacagatctgggatctttcgtctttattgtcttacgtttctaattagttgggaggatttattttgctaaacagtttactaacacattacatttcaaaaactattttggtacctttcaaatacagtgtttaaattaaaatagaaaaataagggctcatgacaagtacattatttgattctacttaggatagctttttagcaggatctccttcagaatttttgtcttgactttgaatctttgcctgtttgtctaaacatttgactaacattctgtttgaatttggaagtattctaatacaagatttgaataaagtttatccttaaataaagtttatccttata

SEQ ID NO: 299069 - DNA, 1812 bp, Homo sapiens
tcctgggctccgctgtgtttttctattctggggtgtaaggggcagctggaccactccagctgggactgctaggaaggttgcgggtccacccggccgagccgaacgagggaaatggtcctcacccggccactcgccggttgaaaaggggccgccctggcagggaagcggccgccgcggcgcggtgcagcgcagcggcgagaaggagtgcgttatcgtcttgcgctactgctgaatgtccgtcccggaggaggaggagaggcttttgccgctgacccagagatggccccgagcgagcaaattcctactgtccggctgcgcggctaccgtggccgagctagcaacctttcccctggatctcacaaaaactcgactccaaatgcaaggagaagcagctcttgctcggttgggagacggtgcaagagaatctgccccctataggggaatggtgcgcacagccctagggatcattgaagaggaaggctttctaaagctttggcaaggagtgacacccgccatttacagacacgtagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgtgatctggtcggatctcacaaggccatccaatgagaccccgcacagcattttctaaagaagaatcgaagcctgaccactttcaccttgggcaagaagaaaggtaagagttcttcaaattcagctacataccaccggctctcccaacctcagacggtgggcatttctggatggatggctgcggttatggataaaggctgtaactgttaacacagaaaaacatgaaaagctcaggcccaagaaaggccttggagccagccaaacagaatttgttctaatggacatggatgatgttgaacagaaaaaagtttacaagtgctttgtggttgcactaatgtatactcactgccattttaagagggggaagtacattttaaaatatatttgaatgtcatgtactgatatgcagtagcttattgtttttctagttgcagagaatgtgaagtttaatctcttaaaatatttagatggtctactttttcattgaatttgtcaatatgtaattgcgttgtaaaatatatatatatatatatatatatatatatatatatatatgcttaacttcccaagtgttctgcattgaaccacttagggaaaattttgtttgtttttatgttttgtaatttttaaaattaagtaaagactggatcaaaataattgcatccaacctggaccgtgaaaa

SEQ ID NO: 299070 - DNA, 1909 bp, Homo sapiens
tcctgggctccgctgtgtttttctattctggggtgtaaggggcagctggaccactccagctgggactgctaggaaggttgcgggtccacccggccgagccgaacgagggaaatggtcctcacccggccactcgccggttgaaaaggggccgccctggcagggaagcggccgccgcggcgcggtgcagcgcagcggcgagaaggagtgcgttatcgtcttgcgctactgctgaatgtccgtcccggaggaggaggagaggcttttgccgctgacccagagatggccccgagcgagcaaattcctactgtccggctgcgcggctaccgtggccgagctagcaacctttcccctggatctcacaaaaactcgactccaaatgcaaggagaagcagctcttgctcggttgggagacggtgcaagagaatctgccccctataggggaatggtgcgcacagccctagggatcattgaagaggaaggctttctaaagctttggcaaggagtgacacccgccatttacagacacgtagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatggaagacacctattccacagagactgatttatagggggcagcactttatttttttctggaaacccaagttctctttgactcctctttttgtccaaaagtgatctggtcggatctcacaaggccatccaatgagaccccgcacagcattttctaaagaagaatcgaagcctgaccactttcaccttgggcaagaagaaaggtaagagttcttcaaattcagctacataccaccggctctcccaacctcagacggtgggcatttctggatggatggctgcggttatggataaaggctgtaactgttaacacagaaaaacatgaaaagctcaggcccaagaaaggccttggagccagccaaacagaatttgttctaatggacatggatgatgttgaacagaaaaaagtttacaagtgctttgtggttgcactaatgtatactcactgccattttaagagggggaagtacattttaaaatatatttgaatgtcatgtactgatatgcagtagcttattgtttttctagttgcagagaatgtgaagtttaatctcttaaaatatttagatggtctactttttcattgaatttgtcaatatgtaattgcgttgtaaaatatatatatatatatatatatatatatatatatatatatgcttaacttcccaagtgttctgcattgaaccacttagggaaaattttgtttgtttttatgttttgtaatttttaaaattaagtaaagactggatcaaaataattgcatccaacctggaccgtgaaaa

SEQ ID NO: 299071 - DNA, 1650 bp, Homo sapiens
tcctgggctccgctgtgtttttctattctggggtgtaaggggcagctggaccactccagctgggactgctaggaaggttgcgggtccacccggccgagccgaacgagggaaatggtcctcacccggccactcgccggttgaaaaggggccgccctggcagggaagcggccgccgcggcgcggtgcagcgcagcggcgagaaggagtgcgttatcgtcttgcgctactgctgaatgtccgtcccggaggaggaggagaggcttttgccgctgacccagagatggccccgagcgagcaaattcctactgtccggctgcgcggctaccgtggccgagctagcaacctttcccctggatctcacaaaaactcgactccaaatgcaaggagaagcagctcttgctcggttgggagacggtgcaagagaatctgccccctataggggaatggtgcgcacagccctagggatcattgaagaggaaggctttctaaagctttggcaaggagtgacacccgccatttacagacacgtagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgtgatctggtcggatctcacaaggccatccaatgagaccccgcacagcattttctaaagaagaatcgaagcctgaccactttcaccttgggcaagaaggtttggcctttgagttgctattctatgctgaagagcctgcttagaggaggagtaccaggagggagccagcatttcagatctgaagtagacgataggaatgtggaagaacacatacatagtgcttaagaaatacatttaacctgttatgtcagtatttatcaatgaagtttgataattcacttttctgtcattgttaaagcgtacatactgtaaattaaagggaggtgaatggaaattaatgaataaacattttgagtttccctagtgttgaaggaaggtgtactttttcttgtcagaaagataaaaaaaatcaagttgagatgatgtttgaatttcaagaaaagaggctgctttctgtcagtgccctctcattagatctgtgttaattagttagcactccactgcacatgctaatgacttc

SEQ ID NO: 299072 - DNA, 1996 bp, Homo sapiens
ttacagctaagattcatttcatacgtttgatgcttagctgaaaaattacaataaattctccaatgaaattatgtatctttatttaatgaaaatgcctgctgcgtaccaaggtatgtactagggcatctggggtaagtaaaaacaaacacatagagcctgcctggagaagctcatggtctgatggaaagataagcaagaagagttaatttctaatcaatatgataaaaaggtcagagagcagtttctgaaaaacatgtttttgagttgagtcctgaaagacaaggagatgttagtaaagcagagaagggagaattcattctagaaagatcagacagtgtgtgggaagggcagagtctgaaaagagcatgccccatttggagaagcatcaagaagcccacgtgttagaagcaccggccccatgagacaaagacacagctagagagattgactaggccatgtcggaatgtcctcttattttatacatacataagcatatagatacatatagccaaagttacctttttaatgatcttttttacccagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgaacaggctgctgtgattgtcaacagcagcaggagccagttgaaggtttgataaaagcagatgaagatgcttaaagatgtctgtttgctgaaaatatctttactgttggatctaaatgtgttgtgtggtcaagtctaagaaacacatggtctaaatgtgagattttagaaacagctgaagaaggaacaagggttttgaacctttcaaatggtatggaggagatagtgaaccctgagaatgtctggaatggcatacccaaattggataagagtccacctgagaaaaggggtttggaggtgatggagatttaaccgtggatctatagctgtggccaatcagtcagaagctgcccttgaacaagtggcatcttacgcagaccaacagagtatttgagaaaattgaaaacatgtaaccacaagaagttgtcattttcaaaaacttctatataggtggaaaacaaattaggtctcaggttgatggtggggtgtgtttatagtgatcctgttatatatacagatctgggatctttcgtctttattgtcttacgtttctaattagttgggaggatttattttgctaaacagtttactaacacattacatttcaaaaactattttggtacctttcaaatacagtgtttaaattaaaatagaaaaataagggctcatgacaagtacattatttgattctacttaggatagctttttagcaggatctccttcagaatttttgtcttgactttgaatctttgcctgtttgtctaaacatttgactaacattctgtttgaatttggaagtattctaatacaagatttgaataaagtttatccttaaataaagtttatccttata

SEQ ID NO: 299073 - DNA, 2006 bp, Homo sapiens
ctaatatgccactcattaagggcttttacctcggctgtccacatccagtcatgcatttggggccaggcatgcctgcgaaatgattgacattcctgtaggtgccccatagaggtgtggcattgagaaattatgtctggaaaatacagccagtgtagtgagcagctgagttaccattcagcctcatggtctgatggaaagataagcaagaagagttaatttctaatcaatatgataaaaaggtcagagagcagtttctgaaaaacatgtttttgagttgagtcctgaaagacaaggagatgttagtaaagcagagaagggagaattcattctagaaagatcagacagtgtgtgggaagggcagagtctgaaaagagcatgccccatttggagaagcatcaagaagcccacgtgttagaagcaccggccccatgagacaaagacacagctagagagattgactaggccatgtcggaatgtcctcttattttatacatacataagcatatagatacatatagccaaagttacctttttaatgatcttttttacccagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgaacaggctgctgtgattgtcaacagcagcaggagccagttgaaggtttgataaaagcagatgaagatgcttaaagatgtctgtttgctgaaaatatctttactgttggatctaaatgtgttgtgtggtcaagtctaagaaacacatggtctaaatgtgagattttagaaacagctgaagaaggaacaagggttttgaacctttcaaatggtatggaggagatagtgaaccctgagaatgtctggaatggcatacccaaattggataagagtccacctgagaaaaggggtttggaggtgatggagatttaaccgtggatctatagctgtggccaatcagtcagaagctgcccttgaacaagtggcatcttacgcagaccaacagagtatttgagaaaattgaaaacatgtaaccacaagaagttgtcattttcaaaaacttctatataggtggaaaacaaattaggtctcaggttgatggtggggtgtgtttatagtgatcctgttatatatacagatctgggatctttcgtctttattgtcttacgtttctaattagttgggaggatttattttgctaaacagtttactaacacattacatttcaaaaactattttggtacctttcaaatacagtgtttaaattaaaatagaaaaataagggctcatgacaagtacattatttgattctacttaggatagctttttagcaggatctccttcagaatttttgtcttgactttgaatctttgcctgtttgtctaaacatttgactaacattctgtttgaatttggaagtattctaatacaagatttgaataaagtttatccttaaataaagtttatccttata

SEQ ID NO: 299074 - DNA, 1517 bp, Homo sapiens
tcctgggctccgctgtgtttttctattctggggtgtaaggggcagctggaccactccagctgggactgctaggaaggttgcgggtccacccggccgagccgaacgagggaaatggtcctcacccggccactcgccggttgaaaaggggccgccctggcagggaagcggccgccgcggcgcggtgcagcgcagcggcgagaaggagtgcgttatcgtcttgcgctactgctgaatgtccgtcccggaggaggaggagaggcttttgccgctgacccagagatggccccgagcgagcaaattcctactgtccggctgcgcggctaccgtggccgagctagcaacctttcccctggatctcacaaaaactcgactccaaatgcaaggagaagcagctcttgctcggttgggagacggtgcaagagaatctgccccctataggggaatggtgcgcacagccctagggatcattgaagaggaaggctttctaaagctttggcaaggagtgacacccgccatttacagacacgtagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgtgatctggtcggatctcacaaggccatccaatgagaccccgcacagcattttctaaagaagaatcgaagcctgaccactttcaccttgggcaagaaggtttggcctttgagttgctattctatgctgaagagcctgcttagaggaggagtaccaggagggagccagcatttcagatctgaagtagacgataggaatgtggaagaacacatacatagtgcttaagaaatacatttaacctgttatgtcagtatttatcaacccccccctacaagcgccctgcgcgcacgggagggagcgtgcccctccgcgctcaaggaccggggtactcggtacgtaagtgcccttcgtcttgagattcggggcacgaatgaaaaggcggccgct

SEQ ID NO: 299075 - DNA, 1976 bp, Homo sapiens
ttacagctaagattcatttcatacgtttgatgcttagctgaaaaattacaataaattctccaatgaaattatgtatctttatttaatgaaaatgcctgctgcgtaccaaggtatgtactagggcatctggggtaagtaaaaacaaacacatagagcctgcctggagaagctcatggtctgatggaaagataagcaagaagagttaatttctaatcaatatgataaaaaggtcagagagcagtttctgaaaaacatgtttttgagttgagtcctgaaagacaaggagatgttagtaaagcagagaagggagaattcattctagaaagatcagacagtgtgtgggaagggcagagtctgaaaagagcatgccccatttggagaagcatcaagaagcccacgtgttagaagcaccggccccatgagacaaagacacagctagagagattgactaggccatgtcggaatgtcctcttattttatacatacataagcatatagatacatatagccaaagttacctttttaatgatcttttttacccagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgaccccttggtcaatggtgttctggcttacttatgaaaaaatcagagagatgagtggagtcagtccattttaaacccctaaagatgcaacccttaaagatacagtgttcagtattattgaaatatgggcatctgcaacacataccccctattatttctacctctttaggaagacacctattccacagagactgatttatagggggcagcactttatttttttctggaaacccaagttctctttgactcctctttttgtccaaaagtgatctggtcggatctcacaaggccatccaatgagaccccgcacagcattttctaaagaagaatcgaagcctgaccactttcaccttgggcaagaagaaaggtaagagttcttcaaattcagctacataccaccggctctcccaacctcagacggtgggcatttctggatggatggctgcggttatggataaaggctgtaactgttaacacagaaaaacatgaaaagctcaggcccaagaaaggccttggagccagccaaacagaatttgttctaatggacatggatgatgttgaacagaaaaaagtttacaagtgctttgtggttgcactaatgtatactcactgccattttaagagggggaagtacattttaaaatatatttgaatgtcatgtactgatatgcagtagcttattgtttttctagttgcagagaatgtgaagtttaatctcttaaaatatttagatggtctactttttcattgaatttgtcaatatgtaattgcgttgtaaaatatatatatatatatatatatatatatatatatatatatgcttaacttcccaagtgttctgcattgaaccacttagggaaaattttgtttgtttttatgttttgtaatttttaaaattaagtaaagactggatcaaaataattgcatccaacctggaccgtgaaaa

SEQ ID NO: 299076 - DNA, 1942 bp, Homo sapiens
ttacagctaagattcatttcatacgtttgatgcttagctgaaaaattacaataaattctccaatgaaattatgtatctttatttaatgaaaatgcctgctgcgtaccaaggtatgtactagggcatctggggtaagtaaaaacaaacacatagagcctgcctggagaagctcatggtctgatggaaagataagcaagaagagttaatttctaatcaatatgataaaaaggtcagagagcagtttctgaaaaacatgtttttgagttgagtcctgaaagacaaggagatgttagtaaagcagagaagggagaattcattctagaaagatcagacagtgtgtgggaagggcagagtctgcggccccatgagacaaagacacagctagagagattgactaggccatgtcggaatgtcctcttattttatacatacataagcatatagatacatatagccaaagttacctttttaatgatcttttttacccagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgaacaggctgctgtgattgtcaacagcagcaggagccagttgaaggtttgataaaagcagatgaagatgcttaaagatgtctgtttgctgaaaatatctttactgttggatctaaatgtgttgtgtggtcaagtctaagaaacacatggtctaaatgtgagattttagaaacagctgaagaaggaacaagggttttgaacctttcaaatggtatggaggagatagtgaaccctgagaatgtctggaatggcatacccaaattggataagagtccacctgagaaaaggggtttggaggtgatggagatttaaccgtggatctatagctgtggccaatcagtcagaagctgcccttgaacaagtggcatcttacgcagaccaacagagtatttgagaaaattgaaaacatgtaaccacaagaagttgtcattttcaaaaacttctatataggtggaaaacaaattaggtctcaggttgatggtggggtgtgtttatagtgatcctgttatatatacagatctgggatctttcgtctttattgtcttacgtttctaattagttgggaggatttattttgctaaacagtttactaacacattacatttcaaaaactattttggtacctttcaaatacagtgtttaaattaaaatagaaaaataagggctcatgacaagtacattatttgattctacttaggatagctttttagcaggatctccttcagaatttttgtcttgactttgaatctttgcctgtttgtctaaacatttgactaacattctgtttgaatttggaagtattctaatacaagatttgaataaagtttatccttaaataaagtttatccttata

SEQ ID NO: 299077 - DNA, 710 bp, Homo sapiens
actgccagcggcctgactcttactcagtttagcaaaaattcttgcctaaaaagtgataagtaaaaatctgtttatggtatacagttatgtctcgaatctttgaatcaaatccatgttcttattttagaaaggtaagagttcttcaaattcagctacataccaccggctctcccaacctcagacggtgggcatttctggatggatggctgcggttatggataaaggctgtaactgttaacacagaaaaacatgaaaagctcaggcccaagaaaggccttggagccagccaaacagaatttgttctaatggacatggatgatgttgaacagaaaaaagtttacaagtgctttgtggttgcactaatgtatactcactgccattttaagagggggaagtacattttaaaatatatttgaatgtcatgtactgatatgcagtagcttattgtttttctagttgcagagaatgtgaagtttaatctcttaaaatatttagatggtctactttttcattgaatttgtcaatatgtaattgcgttgtaaaatatatatatatatatatatatatatatatatatatatatgcttaacttcccaagtgttctgcattgaaccacttagggaaaattttgtttgtttttatgttttgtaatttttaaaattaagtaaagactggatcaaaataattgcatccaacctggaccgtgaaaa

SEQ ID NO: 299078 - DNA, 578 bp, Homo sapiens
ttagctgaaggaggaatacgagggctttgggcaggctgggtacccaatatacaaagagcagcactggtgaatatgggaggtaatgaaaactttgttaaattctaaaaagtcctaattgccttaatagctgtaagcacttatattagggaaattaaaatttatgttttatttttaatatattggtgaccatatattgttgactggctgtatagatgttctaggtcataactgaatattttccacagagcatttttgcttcattctatagtgatgtatgaaaaggataggatttactaaaataggcaaattgtgacaataaggacacaaggctaaactatttgtaaggcctcccctccagtccagaccttcctttaagattaaaactgatatatacagctatctgatcattattatatccagactgtccaaatctttcccctggcaatcctgctcctattcctaaataatcaatttttatacagtctcacaccccaggctggaaacctcaatgttctcttaactcatccctacccctcacttctcatattcacataccaattctgtctcccaaatatttc

SEQ ID NO: 299079 - DNA, 470 bp, Homo sapiens
gggacttttgtataaatcatcgactgactgcttgattcaggctgttcaaggtgaaggattcatgagtctatataaaggctttttaccatcttggctgagaatggtaaagttaggtttacttcctttgttttttttctttgtacttaaattacttttaatttataagcattttcccttttctcttctggtttgaagcatggccctgccccccaaatcaaggtcctttctttcttttttaaatcttcttttatttcctttcacttctcctcagagttatcttgccttctgtggtagagtaaggtaaaataagttacatccattgacgaataagttgatagtcttgttataaagccagtaaatagattttctgtaatgtaaaatttttagtatttcatttagtcatattttaatacaatattttagaatatatatacagattttacactagagacctctcctacaaaaaaaaa

SEQ ID NO: 299080 - DNA, 5841 bp, Homo sapiens
cagctttccgacatcaccagccaaggatttttttccccgctctccttagtcgccgtccgtccatcagtacctgcaggggggaggaggaggagggaggaaagcggaaagaggaaaaagcataagcttgagccttccgatccgaccacgaatactcctgtaataaacccaccgccccaacaaatctgccatagcagccgccgccgccgccggtcacttctcgtctcagcgctttctttgcttcttggtttgttgggggtagcttttatgaaacaaatctttgctattaagccacttacattttggggggttccttagagtctcccttgggggggcttctccctccctttagcccccctcggtttggaggttggattcagttggatacggcgcaaggttctgggctcctgctggcttttttttcctctctctcatcgacccccctttggttcccaccccccaccttttgcttttcgtatgtatgcatttttaaaaataaatcctgattttggaagctgagccggggaaaatgggcaacggtgattgggaccgaaggggagtctctccgtcactgttgctgggacgcgtgcctgtgctggtgtcttagagcaagagcctccctgagctttcggagtggaaggccaaatgacataggatgaaggctgttcgtaacctgctgatttatatattttccacctatctcctggttatgtttggatttaatgctgcccaagacttctggtgttcaactttggtgaagggagtcatttatggatcgtattctgtaagtgaaatgtttcctaaaaactttacaaactgcacttggacgctggaaaatccagatccaaccaaatatagcatttacctgaaattttccaaaaaggaccttagctgctctaacttttcactcctggcttatcagtttgatcatttttcccatgaaaaaataaaggatcttttaagaaagaatcattctataatgcaactctgcaattccaagaatgctttcgtttttctacagtatgataaaaattttattcaaatacgtcgagtatttccaactaatttcccaggattacagaaaaaaggggaagaagatcagaaatctttttttgagtttttggtattgaacaaggtcagcccaagccagtttggttgccatgtattatgtacttggttggagagctgcttaaaatcagaaaatgggagaacagaatcatgtgggatcatgtatacaaaatgcacctgccctcagcatttgggagagtgggggatcgacgaccagtcgctgattttgttaaataacgtggtgttacccctgaatgagcagacagagggctgcctgacccaggagctgcaaaccacccaagtctgcaatcttaccagggaggccaagcgaccacccaaagaagaatttggaatgatgggagatcatacaattaaaagtcagcgacctcgatctgttcatgaaaaaagggtccctcaggaacaagctgatgctgctaaatttatggcacaaactggtgaatctggtgtggaagagtggtcccagtggagcacatgttcggttacttgtggtcaagggtcgcaggtgcgaaccagaacttgtgtatcaccttacgggacacactgcagcggcccattaagagaatcaagggtttgcaataacactgccctctgtccagtacacggagtatgggaggaatggtcaccatggagtttatgttcatttacatgtggtcgaggccaaagaacaagaacaaggtcatgcacacctcctcagtatggaggaaggccgtgtgaaggacctgaaacacatcataagccttgtaatattgctctttgcccagttgatggacagtggcaagagtggagttcgtggagccagtgctcagtaacgtgctcgaatgggactcagcagagaagccggcagtgcactgcagctgcccatggaggctccgaatgcagagggccatgggcagaaagcagagagtgctataaccctgaatgtacagccaatggtcaatggaatcagtggggtcattggagtggttgttccaagtcctgtgatggcggctgggaaaggcgaataaggacctgtcagggtgcagtgataacagggcagcaatgtgaaggaacgggcgaagaagtgagaagatgcagtgagcagcgatgccctgcaccttatgaaatatgccctgaggattatctgatgtcgatggtgtggaaaagaactccagcaggcgacttggcattcaatcaatgtcccctgaatgccacaggcaccactagcagacgctgctctctcagtcttcatggagtggccttctgggaacagccgagctttgcaagatgcatatcaaatgagtacagacacttgcagcattcaattaaagagcaccttgctaaggggcagcgaatgctggcaggtgatggaatgtcccaggtgaccaagacactgttggatttaactcagagaaaaaatttctatgcaggcgatcttctgatgtctgtggagatcctgagaaatgtgacagacacatttaaaagggcaagttacatccctgcatctgatggtgtccagaacttctttcaaatagttagcaaccttctagatgaagaaaacaaggaaaaatgggaagatgcacaacagatttatccagggtcaatagagttaatgcaggtgattgaagattttatacacattgttggaatggggatgatggactttcagaattcatacttaatgactggaaatgtagtggctagtattcagaagcttcctgcagcctctgttctaacagacatcaactttccaatgaaaggacggaagggaatggttgactgggcaagaaactcagaagatagggtagtaattccaaaaagcattttcactccggtgtcatcaaaagaattagatgaatcatctgtatttgttcttggcgcagtcctatacaaaaacttagatctaattttgcccactttgagaaattatactgtcattaattccaaaatcatcgtggtcacaataaggcctgaacccaaaacaaccgattcgtttctggagatagaactagctcatttggctaatggtactttgaatccctattgtgtattgtgggatgactccaaaacgaacgagtctttgggaacgtggtccacccagggatgtaaaactgtgcttaccgatgcatcccatacgaaatgcttatgtgatcgtctctctaccttcgccattttggctcagcaacctagagaaataatcatggaatcctctggcacaccttcagttaccctaatagtaggcagtggtctttcttgcttggccttgattaccctagcagttgtctatgcagcattatggaggtacatacgctctgagagatccataatactaattaacttctgcctgtctatcatctcatccaatatcctcatactggttggacagactcagacacataataagagtatctgcacaaccaccactgcatttttgcactttttcttcctggcttcattctgttgggttttgactgaggcgtggcaatcatatatggctgtaactggaaaaattaggacacggcttataagaaaacgctttttgtgccttggatggggtttaccagcattagtagtggccacatcagtaggcttcaccagaacaaaaggatatggcactgatcactactgctggctctctcttgaaggaggactactctatgcttttgtgggacctgcagccgctgttgtcctggtcaacatggtgattggcattttggtatttaataaacttgtttccagagatggaatcctagataaaaagctcaaacacagagccggtcagatgagtgagcctcatagcggtttgacgctcaaatgtgccaagtgtggagtagtttcaacaacagctttgtcagccaccaccgccagtaacgccatggcgtctctttggagctcctgtgtggtgttgccccttctggctttgacgtggatgtctgcggttctggccatgacagataaacgctccatattgtttcaaatactttttgctgtgtttgattcattgcaaggctttgttatagtcatggtccactgcattcttcggagagaggttcaggatgcatttagatgccgattgagaaactgtcaggatcccatcaatgcagattcttcgagttcgtttcctaatgggcatgctcaaatcatgacagactttgaaaaggatgtagacattgcctgtcgatcagttcttcataaggatattggtccttgccgagcagccacaataacaggaacactttctaggatttctctaaatgatgatgaagaagaaaagggaacaaaccctgaagggctaagctattcaacattgcctggaaatgtcatttccaaagtcatcatccagcaacccacaggtttgcacatgcccatgagtatgaatgagcttagcaatccatgtttgaaaaaagaaaatagtgaattgcggagaactgtgtacttatgtacggatgataatttgagaggggctgacatggacatagtccatcctcaagaaagaatgatggaaagtgactatattgtgatgcccagaagttctgtaaataaccagccttcaatgaaagaagaaagcaaaatgaatattggcatggaaaccttgccacatgaaaggctattgcactacaaagtaaaccctgaattcaatatgaatccccctgtaatggaccagttcaatatgaacttagagcaacatctcgcaccccaggaacatatgcagaatttgccctttgaacctcgcacagctgtgaagaatttcatggcctctgagttggatgataatgcaggactatcaagaagtgaaactggatcaacgatatcaatgagttctttagagagaagaaaatcacgatattcagaccttgactttgagaaggtcatgcatacaaggaagaggcatatggaactatttcaagaactaaatcagaaatttcaaactttggacagatttcgggatataccaaatacaagcagtatggaaaaccccgcaccaaacaagaatccatgggacactttcaaaaaccccagtgaatacccgcattacaccacaatcaatgtcttagacacagaggcaaaggatgctttggaactgaggccagcagagtgggagaagtgtctgaatttgcctctggatgtgcaagagggtgactttcaaacagaagtttaaaaaaatcaaaatggactaaggtagagacaaaactttattgcactgacacttaagacttgggaagcctgacatttctatctggacagtgtgactatcttatgtcaggaccttcatgtgccaaacgtcagtggtgttttcatatggtaacttctcactagtcaggctagtggagagatgaccaggtgtacagttctgaccatcctgtgttgtaagtacccgtggaatggatttgtaaggtaatctttatagataaacctcaagcaacgattcatgttgtaaccgcttcatatggtttagttttcaaaaaacttcaccatgaagcacaatgtatatatttatgcagtttttaaagtttataacagtctgtttggccattactacactttttactttataatataaaagcaaagtttttgtcattaaatgaatgtttgttgagctacattcttcattgctttaaatgcaataaagtaataatctcacttttatatgaataatatatttcacatctttattattgcagttttctctagaaagctctgagaagctttctctgctgcagctgtgtataaaatatttaaaatgttgtatggtgtaaataaacttttgtctacatatca

SEQ ID NO: 299081 - DNA, 5844 bp, Homo sapiens
cagctttccgacatcaccagccaaggatttttttccccgctctccttagtcgccgtccgtccatcagtacctgcaggggggaggaggaggagggaggaaagcggaaagaggaaaaagcataagcttgagccttccgatccgaccacgaatactcctgtaataaacccaccgccccaacaaatctgccatagcagccgccgccgccgccggtcacttctcgtctcagcgctttctttgcttcttggtttgttgggggtagcttttatgaaacaaatctttgctattaagccacttacattttggggggttccttagagtctcccttgggggggcttctccctccctttagcccccctcggtttggaggttggattcagttggatacggcgcaaggttctgggctcctgctggcttttttttcctctctctcatcgacccccctttggttcccaccccccaccttttgcttttcgtatgtatgcatttttaaaaataaatcctgattttggaagctgagccggggaaaatgggcaacggtgattgggaccgaaggggagtctctccgtcactgttgctgggacgcgtgcctgtgctggtgtcttagagcaagagcctccctgagctttcggagtggaagaacagtggaagagactgcagcctaaagacttttaaaattaacttggcatcacttttatcagctcaaaggctaaacaaacaaacaaaagcagtgtcatttattctaagaaataacttcttaaaggttaaagctgaaaaatattcaagttatttttggataacaacttacagaggccaaatgacataggatgaaggctgttcgtaacctgctgatttatatattttccacctatctcctggttatgtttggatttaatgctgcccaagacttctggtgttcaactttggtgaagggagtcatttatggatcgtattctgtaagtgaaatgtttcctaaaaactttacaaactgcacttggacgctggaaaatccagatccaaccaaatatagcatttacctgaaattttccaaaaaggaccttagctgctctaacttttcactcctggcttatcagtttgatcatttttcccatgaaaaaataaaggatcttttaagaaagaatcattctataatgcaactctgcaattccaagaatgctttcgtttttctacagtatgataaaaattttattcaaatacgtcgagtatttccaactaatttcccaggattacagaaaaaaggggaagaagatcagaaatctttttttgagtttttggtattgaacaaggtcagcccaagccagtttggttgccatgtattatgtacttggttggagagctgcttaaaatcagaaaatgggagaacagaatcatgtgggatcatgtatacaaaatgcacctgccctcagcatttgggagagtgggggatcgacgaccagtcgctgattttgttaaataacgtggtgttacccctgaatgagcagacagagggctgcctgacccaggagctgcaaaccacccaagtctgcaatcttaccagggaggccaagcgaccacccaaagaagaatttggaatgatgggagatcatacaattaaaagtcagcgacctcgatctgttcatgaaaaaagggtccctcaggaacaagctgatgctgctaaatttatggcacaaactggtgaatctggtgtggaagagtggtcccagtggagcacatgttcggttacttgtggtcaagggtcgcaggtgcgaaccagaacttgtgtatcaccttacgggacacactgcagcggcccattaagagaatcaagggtttgcaataacactgccctctgtccagtacacggagtatgggaggaatggtcaccatggagtttatgttcatttacatgtggtcgaggccaaagaacaagaacaaggtcatgcacacctcctcagtatggaggaaggccgtgtgaaggacctgaaacacatcataagccttgtaatattgctctttgcccagttgatggacagtggcaagagtggagttcgtggagccagtgctcagtaacgtgctcgaatgggactcagcagagaagccggcagtgcactgcagctgcccatggaggctccgaatgcagagggccatgggcagaaagcagagagtgctataaccctgaatgtacagccaatggtcaatggaatcagtggggtcattggagtggttgttccaagtcctgtgatggcggctgggaaaggcgaataaggacctgtcagggtgcagtgataacagggcagcaatgtgaaggaacgggcgaagaagtgagaagatgcagtgagcagcgatgccctgcaccttatgaaatatgccctgaggattatctgatgtcgatggtgtggaaaagaactccagcaggcgacttggcattcaatcaatgtcccctgaatgccacaggcaccactagcagacgctgctctctcagtcttcatggagtggccttctgggaacagccgagctttgcaagatgcatatcaaatgagtacagacacttgcagcattcaattaaagagcaccttgctaaggggcagcgaatgctggcaggtgatggaatgtcccaggtgaccaagacactgttggatttaactcagagaaaaaatttctatgcaggcgatcttctgatgtctgtggagatcctgagaaatgtgacagacacatttaaaagggcaagttacatccctgcatctgatggtgtccagatttatccagggtcaatagagttaatgcaggtgattgaagattttatacacattgttggaatggggatgatggactttcagaattcatacttaatgactggaaatgtagtggctagtattcagaagcttcctgcagcctctgttctaacagacatcaactttccaatgaaaggacggaagggaatggttgactgggcaagaaactcagaagatagggtagtaattccaaaaagcattttcactccggtgtcatcaaaagaattagatgaatcatctgtatttgttcttggcgcagtcctatacaaaaacttagatctaattttgcccactttgagaaattatactgtcattaattccaaaatcatcgtggtcacaataaggcctgaacccaaaacaaccgattcgtttctggagatagaactagctcatttggctaatggtactttgaatccctattgtgtattgtgggatgactccaaaacgaacgagtctttgggaacgtggtccacccagggatgtaaaactgtgcttaccgatgcatcccatacgaaatgcttatgtgatcgtctctctaccttcgccattttggctcagcaacctagagaaataatcatggaatcctctggcacaccttcagttaccctaatagtaggcagtggtctttcttgcttggccttgattaccctagcagttgtctatgcagcattatggaggtacatacgctctgagagatccataatactaattaacttctgcctgtctatcatctcatccaatatcctcatactggttggacagactcagacacataataagagtatctgcacaaccaccactgcatttttgcactttttcttcctggcttcattctgttgggttttgactgaggcgtggcaatcatatatggctgtaactggaaaaattaggacacggcttataagaaaacgctttttgtgccttggatggggtaagcatattgatataccgtttcatgctcttctcaaaatgacgttgaacacacattagaaagcagtcatgagtgattagacacaggctactttgtgtctaatttaatctatggaagtgaaaatacatgagctggtcagttttgaacattcattggtcatttggaactttaaaaggaagtaagtattgaatgctcatttagctagtcagttaacattcaacagtgtctagatagtatgaaatgagaccccgagatgcctacacacagaaaaacagtgctctctgttaatattttctgaaagtgcaaaataccttaaaattttcaaggcctaatgtgtgatggttcactaggcatgtactcccaccaagaaaacttagaagatttcatttcaagaaatctcaaagcaattaaagaataaaagcgattcatttcatagggagaacaccatctagagaattaatgaaacctcacagcttgttgacctggtcctcaaaagcagaaacagaattgctgacagactgagaactaattctttacttgtgtttattaagaagtttctctcaaattgcctcatgacatggacatctcaaagatctatattatagggccaattctaatgatagcctagttaatttaagaagctacttttagaaaaagcccaaatatacaataatatctactgtattagaagactggcatatgggatgctaggaggaacctgggaaattacaaataagtgtgcttataacaattccagaattatttaggctggaaaaatatgatcaagaacacgtaaatattattcattaggtttcagcaaggtctattatgtctagctaataaattaggactttatccacagacaaatggaaaagcaattaataagaagttgaagagtaggccagacatggtggctcacgcctgtaatcctagcactttgggaaaccaaggcgggtggactacctgagcgtgggtggactacctgagcgcgggtggactacctgagcacgggagttcgagattagcctgagcaatatggcaaaaccccatctctaccaaaaatgcaaaaaattagccgggagtgatggcacatacctgtagtcccagctactcgggaggctaaggtgggaggattgcatgagcctgggaagtggaggttgcagtgagccaagatcacaccacgacactccaacttgtgtcacagagtaagaccctatctcacaccaacacaaaagttgaagactttgttctacttagaatttcatcaaatttttgtctaaatttcctgacaaaggccttctaaagttgagatagtatttaaatcaagggacacttttgccatgaattagtaccattctaagaaatacagaatacaggtaaaagaacacattttttgatgaagaacaaaacatggtgattttcaagattagtgactaccttgtttaaaattattactaaagattttgaggagagggttcacagacagtctccgtatttacagctaatattaaactactctaggtagcaaaaacctgaactgatggtgctaaagtatcagaaagtttatgggttggcagaatagtggtgtgtgtgtttcattatgaacaagtacaataaaatgaatctagaaaaaatttaatctaaattgtatgaaataaatactattaattcttcagttataacccatgaggaatttttttttcctaatgaacttggtccagtcaatcaaaaaaaatcaacaaatgacatgtgtggaggaagaggagaaggagggacaagaagaggagaaacagaaggaggaaagggaagaggaggaaagggaggataaggatgaggaggggactatatatttataattttatatacatatatgtatagtcaccagtgtttgtttaacactatggtgtgtccttctgagatgttttccatagttcttgtcattaaatctcatgaaggaatgtgatgccactagagaaggctcacagaagagaatagcaggaggtatgtgaaatgatagtaagaaagaagacagacagaggacatacaataaaatgattagatgacggatttttcaaccggaaaaggcaaacatgatcttcctgaaaagaaggcataaccaaaact

SEQ ID NO: 299082 - DNA, 784 bp, Homo sapiens
  misc_feature (738)..(738): n is a, c, g, or t
  misc_feature (741)..(741): n is a, c, g, or t
atgtatagattttttattccttctaacctttgcttatttttctagatttatccagggtcaatagagttaatgcaggtgattgaagattttatacacattgttggaatggggatgatggactttcagaattcatacttaatgactggaaatgtaggtaagaaataggattttcccccaaaatctttctgaaataaaaaaaaattgcaagtatctacaccatacgtttccaagtataatattcattattcatatgtttaactgcatgtgagcaaatatatttctaatacttggtatctgacttttagatgggcctaaacacattgcattatatatatgtacacgtatatttgtatttatcttcatgcatttgtatgattgcttgtaggcctatttttgtgtatctttacatgtatatgtaggataatatgtatttattttttcattctgccaaatgctcattgctatctaatctagttatgaatgtgtgtgtgtgtatacacactagtaattttgaaaaacaacatattagtctttatgatcttccgtacattgttcttgaggatgccgagttactttctcactgattgtcccaggcaggagctgaatctgtgtgtggtagaacacttgagaataacttccagggttaagatgatggtgcaactgctgccaatgcagtttttctgaatatgttccagtacacagtggatctccggtaactcgggtatagtaacccaagcntcnttcaaaatacctaacccgcggtccggagcgggctctccggtgc

SEQ ID NO: 299083 - DNA, 2762 bp, Homo sapiens
caaggacgtcagaggcgagctggactgagtgaagtgtggagtaggaagcttaggaacgagtctttgggaacgtggtccacccagggatgtaaaactgtgcttaccgatgcatcccatacgaaatgcttatgtgatcgtctctctaccttcgccattttggctcagcaacctagagaaataatcatggaatcctctggcacaccttcagttaccctaatagtaggcagtggtctttcttgcttggccttgattaccctagcagttgtctatgcagcattatggaggtacatacgctctgagagatccataatactaattaacttctgcctgtctatcatctcatccaatatcctcatactggttggacagactcagacacataataagagtatctgcacaaccaccactgcatttttgcactttttcttcctggcttcattctgttgggttttgactgaggcgtggcaatcatatatggctgtaactggaaaaattaggacacggcttataagaaaacgctttttgtgccttggatggggtttaccagcattagtagtggccacatcagtaggcttcaccagaacaaaaggatatggcactgatcactactgctggctctctcttgaaggaggactactctatgcttttgtgggacctgcagccgctgttgtcctggtcaacatggtgattggcattttggtatttaataaacttgtttccagagatggaatcctagataaaaagctcaaacacagagccggtcagatgagtgagcctcatagcggtttgacgctcaaatgtgccaagtgtggagtagtttcaacaacagctttgtcagccaccaccgccagtaacgccatggcgtctctttggagctcctgtgtggtgttgccccttctggctttgacgtggatgtctgcggttctggccatgacagataaacgctccatattgtttcaaatactttttgctgtgtttgattcattgcaaggctttgttatagtcatggtccactgcattcttcggagagaggttcaggatgcatttagatgccgattgagaaactgtcaggatcccatcaatgcagattcttcgagttcgtttcctaatgggcatgctcaaatcatgacagactttgaaaaggatgtagacattgcctgtcgatcagttcttcataaggatattggtccttgccgagcagccacaataacaggaacactttctaggatttctctaaatgatgatgaagaagaaaagggaacaaaccctgaagggctaagctattcaacattgcctggaaatgtcatttccaaagtcatcatccagcaacccacaggtttgcacatgcccatgagtatgaatgagcttagcaatccatgtttgaaaaaagaaaatagtgaattgcggagaactgtgtacttatgtacggatgataatttgagaggggctgacatggacatagtccatcctcaagaaagaatgatggaaagtgactatattgtgatgcccagaagttctgtaaataaccagccttcaatgaaagaagaaagcaaaatgaatattggcatggaaaccttgccacatgaaaggctattgcactacaaagtaaaccctgaattcaatatgaatccccctgtaatggaccagttcaatatgaacttagagcaacatctcgcaccccaggaacatatgcagaatttgccctttgaacctcgcacagctgtgaagaatttcatggcctctgagttggatgataatgcaggactatcaagaagtgaaactggatcaacgatatcaatgagttctttagagagaagaaaatcacgatattcagaccttgactttgagaaggtcatgcatacaaggaagaggcatatggaactatttcaagaactaaatcagaaatttcaaactttggacagatttcgggatataccaaatacaagcagtatggaaaaccccgcaccaaacaagaatccatgggacactttcaaaaaccccagtgaatacccgcattacaccacaatcaatgtcttagacacagaggcaaaggatgctttggaactgaggccagcagagtgggagaagtgtctgaatttgcctctggatgtgcaagagggtgactttcaaacagaagtttaaaaaaatcaaaatggactaaggtagagacaaaactttattgcactgacacttaagacttgggaagcctgacatttctatctggacagtgtgactatcttatgtcaggaccttcatgtgccaaacgtcagtggtgttttcatatggtaacttctcactagtcaggctagtggagagatgaccaggtgtacagttctgaccatcctgtgttgtaagtacccgtggaatggatttgtaaggtaatctttatagataaacctcaagcaacgattcatgttgtaaccgcttcatatggtttagttttcaaaaaacttcaccatgaagcacaatgtatatatttatgcagtttttaaagtttataacagtctgtttggccattactacactttttactttataatataaaagcaaagtttttgtcattaaatgaatgtttgttgagctacattcttcattgctttaaatgcaataaagtaataatctcacttttatatgaataatatatttcacatctttattattgcagttttctctagaaagctctgagaagctttctctgctgcagctgtgtataaaatatttaaaatgttgtatggtgtaaataaacttttgtctacatatca

SEQ ID NO: 299084 - DNA, 2957 bp, Homo sapiens
tttcagcacctccggcgctggacagctctctgcacgccgcaccgccgcctgcttgctttttcccactctcgctttgcattactggagatgcatctaaattacatcctgttcaacaacaagtagatttttttttcctgtacaggaattacagtagacgactctctcaattaaactgcattttcttctttacggatttggctatcaggcgtatttatcccgatttcctcccccctcactcccctttgcaggaacgagtctttgggaacgtggtccacccagggatgtaaaactgtgcttaccgatgcatcccatacgaaatgcttatgtgatcgtctctctaccttcgccattttggctcagcaacctagagaaataatcatggaatcctctggcacaccttcagttaccctaatagtaggcagtggtctttcttgcttggccttgattaccctagcagttgtctatgcagcattatggaggtacatacgctctgagagatccataatactaattaacttctgcctgtctatcatctcatccaatatcctcatactggttggacagactcagacacataataagagtatctgcacaaccaccactgcatttttgcactttttcttcctggcttcattctgttgggttttgactgaggcgtggcaatcatatatggctgtaactggaaaaattaggacacggcttataagaaaacgctttttgtgccttggatggggtttaccagcattagtagtggccacatcagtaggcttcaccagaacaaaaggatatggcactgatcactactgctggctctctcttgaaggaggactactctatgcttttgtgggacctgcagccgctgttgtcctggtcaacatggtgattggcattttggtatttaataaacttgtttccagagatggaatcctagataaaaagctcaaacacagagccggtcagatgagtgagcctcatagcggtttgacgctcaaatgtgccaagtgtggagtagtttcaacaacagctttgtcagccaccaccgccagtaacgccatggcgtctctttggagctcctgtgtggtgttgccccttctggctttgacgtggatgtctgcggttctggccatgacagataaacgctccatattgtttcaaatactttttgctgtgtttgattcattgcaaggctttgttatagtcatggtccactgcattcttcggagagaggttcaggatgcatttagatgccgattgagaaactgtcaggatcccatcaatgcagattcttcgagttcgtttcctaatgggcatgctcaaatcatgacagactttgaaaaggatgtagacattgcctgtcgatcagttcttcataaggatattggtccttgccgagcagccacaataacaggaacactttctaggatttctctaaatgatgatgaagaagaaaagggaacaaaccctgaagggctaagctattcaacattgcctggaaatgtcatttccaaagtcatcatccagcaacccacaggtttgcacatgcccatgagtatgaatgagcttagcaatccatgtttgaaaaaagaaaatagtgaattgcggagaactgtgtacttatgtacggatgataatttgagaggggctgacatggacatagtccatcctcaagaaagaatgatggaaagtgactatattgtgatgcccagaagttctgtaaataaccagccttcaatgaaagaagaaagcaaaatgaatattggcatggaaaccttgccacatgaaaggctattgcactacaaagtaaaccctgaattcaatatgaatccccctgtaatggaccagttcaatatgaacttagagcaacatctcgcaccccaggaacatatgcagaatttgccctttgaacctcgcacagctgtgaagaatttcatggcctctgagttggatgataatgcaggactatcaagaagtgaaactggatcaacgatatcaatgagttctttagagagaagaaaatcacgatattcagaccttgactttgagaaggtcatgcatacaaggaagaggcatatggaactatttcaagaactaaatcagaaatttcaaactttggacagatttcgggatataccaaatacaagcagtatggaaaaccccgcaccaaacaagaatccatgggacactttcaaaaaccccagtgaatacccgcattacaccacaatcaatgtcttagacacagaggcaaaggatgctttggaactgaggccagcagagtgggagaagtgtctgaatttgcctctggatgtgcaagagggtgactttcaaacagaagtttaaaaaaatcaaaatggactaaggtagagacaaaactttattgcactgacacttaagacttgggaagcctgacatttctatctggacagtgtgactatcttatgtcaggaccttcatgtgccaaacgtcagtggtgttttcatatggtaacttctcactagtcaggctagtggagagatgaccaggtgtacagttctgaccatcctgtgttgtaagtacccgtggaatggatttgtaaggtaatctttatagataaacctcaagcaacgattcatgttgtaaccgcttcatatggtttagttttcaaaaaacttcaccatgaagcacaatgtatatatttatgcagtttttaaagtttataacagtctgtttggccattactacactttttactttataatataaaagcaaagtttttgtcattaaatgaatgtttgttgagctacattcttcattgctttaaatgcaataaagtaataatctcacttttatatgaataatatatttcacatctttattattgcagttttctctagaaagctctgagaagctttctctgctgcagctgtgtataaaatatttaaaatgttgtatggtgtaaataaacttttgtctacatatca

SEQ ID NO: 299085 - DNA, 3933 bp, Homo sapiens
cagctttccgacatcaccagccaaggatttttttccccgctctccttagtcgccgtccgtccatcagtacctgcaggggggaggaggaggagggaggaaagcggaaagaggaaaaagcataagcttgagccttccgatccgaccacgaatactcctgtaataaacccaccgccccaacaaatctgccatagcagccgccgccgccgccggtcacttctcgtctcagcgctttctttgcttcttggtttgttgggggtagcttttatgaaacaaatctttgctattaagccacttacattttggggggttccttagagtctcccttgggggggcttctccctccctttagcccccctcggtttggaggttggattcagttggatacggcgcaaggttctgggctcctgctggcttttttttcctctctctcatcgacccccctttggttcccaccccccaccttttgcttttcgtatgtatgcatttttaaaaataaatcctgattttggaagctgagccggggaaaatgggcaacggtgattgggaccgaaggggagtctctccgtcactgttgctgggacgcgtgcctgtgctggtgtcttagagcaagagcctccctgagctttcggagtggaaggccaaatgacataggatgaaggctgttcgtaacctgctgatttatatattttccacctatctcctggttatgtttggatttaatgctgcccaagacttctggtgttcaactttggtgaagggagtcatttatggatcgtattctgtaagtgaaatgtttcctaaaaactttacaaactgcacttggacgctggaaaatccagatccaaccaaatatagcatttacctgaaattttccaaaaaggaccttagctgctctaacttttcactcctggcttatcagtttgatcatttttcccatgaaaaaataaaggatcttttaagaaagaatcattctataatgcaactctgcaattccaagaatgctttcgtttttctacagtatgataaaaattttattcaaatacgtcgagtatttccaactaatttcccaggattacagaaaaaaggggaagaagatcagaaatctttttttgagtttttggtattgaacaaggtcagcccaagccagtttggttgccatgtattatgtacttggttggagagctgcttaaaatcagaaaatgggagaacagaatcatgtgggatcatgtatacaaaatgcacctgccctcagcatttgggagagtgggggatcgacgaccagtcgctgattttgttaaataacgtggtgttacccctgaatgagcagacagagggctgcctgacccaggagctgcaaaccacccaagtctgcaatcttaccagggaggccaagcgaccacccaaagaagaatttggaatgatgggagatcatacaattaaaagtcagcgacctcgatctgttcatgaaaaaagggtccctcaggaacaagctgatgctgctaaatttatggcacaaactggtgaatctggtgtggaagagtggtcccagtggagcacatgttcggttacttgtggtcaagggtcgcaggtgcgaaccagaacttgtgtatcaccttacgggacacactgcagcggcccattaagagaatcaagggtttgcaataacactgccctctgtccagtacacggagtatgggaggaatggtcaccatggagtttatgttcatttacatgtggtcgaggccaaagaacaagaacaaggtcatgcacacctcctcagtatggaggaaggccgtgtgaaggacctgaaacacatcataagccttgtaatattgctctttgcccagttgatggacagtggcaagagtggagttcgtggagccagtgctcagtaacgtgctcgaatgggactcagcagagaagccggcagtgcactgcagctgcccatggaggctccgaatgcagagggccatgggcagaaagcagagagtgctataaccctgaatgtacagccaatggtcaatggaatcagtggggtcattggagtggttgttccaagtcctgtgatggcggctgggaaaggcgaataaggacctgtcagggtgcagtgataacagggcagcaatgtgaaggaacgggcgaagaagtgagaagatgcagtgagcagcgatgccctgcaccttatgaaatatgccctgaggattatctgatgtcgatggtgtggaaaagaactccagcaggcgacttggcattcaatcaatgtcccctgaatgccacaggcaccactagcagacgctgctctctcagtcttcatggagtggccttctgggaacagccgagctttgcaagatgcatatcaaatgagtacagacacttgcagcattcaattaaagagcaccttgctaaggggcagcgaatgctggcaggtgatggaatgtcccaggtgaccaagacactgttggatttaactcagagaaaaaatttctatgcaggcgatcttctgatgtctgtggagatcctgagaaatgtgacagacacatttaaaagggcaagttacatccctgcatctgatggtgtccagaacttctttcaaatagttagcaaccttctagatgaagaaaacaaggaaaaatgggaagatgcacaacagatttatccagggtcaatagagttaatgcaggtgattgaagattttatacacattgttggaatggggatgatggactttcagaattcatacttaatgactggaaatgtagtggctagtattcagaagcttcctgcagcctctgttctaacagacatcaactttccaatgaaaggacggaagggaatggttgactgggcaagaaactcagaagatagggtagtaattccaaaaagcattttcactccggtgtcatcaaaagaattagatgaatcatctgtatttgttcttggcgcagtcctatacaaaaacttagatctaattttgcccactttgagaaattatactgtcattaattccaaaatcatcgtggtcacaataaggcctgaacccaaaacaaccgattcgtttctggagatagaactagctcatttggctaatggtactttgaatccctattgtgtattgtgggatgactccaaaacgaacgagtctttgggaacgtggtccacccagggatgtaaaactgtgcttaccgatgcatcccatacgaaatgcttatgtgatcgtctctctaccttcgccattttggctcagcaacctagagaaatatgtctgaatttgcctctggatgtgcaagagggtgactttcaaacagaagtttaaaaaaatcaaaatggactaaggtagagacaaaactttattgcactgacacttaagacttgggaagcctgacatttctatctggacagtgtgactatcttatgtcaggaccttcatgtgccaaacgtcagtggtgttttcatatggtaacttctcactagtcaggctagtggagagatgaccaggtgtacagttctgaccatcctgtgttgtaagtacccgtggaatggatttgtaaggtaatctttatagataaacctcaagcaacgattcatgttgtaaccgcttcatatggtttagttttcaaaaaacttcaccatgaagcacaatgtatatatttatgcagtttttaaagtttataacagtctgtttggccattactacactttttactttataatataaaagcaaagtttttgtcattaaatgaatgtttgttgagctacattcttcattgctttaaatgcaataaagtaataatctcacttttatatgaataatatatttcacatctttattattgcagttttctctagaaagctctgagaagctttctctgctgcagctgtgtataaaatatttaaaatgttgtatggtgtaaataaacttttgtctacatatca

SEQ ID NO: 299086 - DNA, 1778 bp, Homo sapiens
caaggacgtcagaggcgagctggactgagtgaagtgtggagtaggaagcttaggaacgagtctttgggaacgtggtccacccagggatgtaaaactgtgcttaccgatgcatcccatacgaaatgcttatgtgatcgtctctctaccttcgccattttggctcagcaacctagagaaataatcatggaatcctctggcacaccttcagttaccctaatagtaggcagtggtctttcttgcttggccttgattaccctagcagttgtctatgcagcattatggaggtacatacgctctgagagatccataatactaattaacttctgcctgtctatcatctcatccaatatcctcatactggttggacagactcagacacataataagagtatctgcacaaccaccactgcatttttgcactttttcttcctggcttcattctgttgggttttgactgaggcgtggcaatcatatatggctgtaactggaaaaattaggacacggcttataagaaaacgctttttgtgccttggatggggtttaccagcattagtagtggccacatcagtaggcttcaccagaacaaaaggatatggcactgatcactactgctggctctctcttgaaggaggactactctatgcttttgtgggacctgcagccgctgttgtcctggtcaacatggtgattggcattttggtatttaataaacttgtttccagagatggaatcctagataaaaagctcaaacacagagccggtcagatgagtgagcctcatagcggtttgacgctcaaatgtgccaagtgtggagtagtttcaacaacagctttgtcagccaccaccgccagtaacgccatggcgtctctttggagctcctgtgtggtgttgccccttctggctttgacgtggatgtctgcggttctggccatgacagataaacgctccatattgtttcaaatactttttgctgtgtttgattcattgcaaggctttgttatagtcatggtccactgcattcttcggagagaggtgagaagcattcttgtgatagagaacagtgatggttggaatggtatttccttgctaaaaagaatgatcttttaatatcttgatgttcagattaaagctggtctcctccattgacaatcacttgggaatcaaagctgaaggaatgctttaagacacagcttgggagagcccccagcactctgaaagtgacagattagaacagatgggactatgccaggaaaaacacaaccagaggtgtcaaaagccaggaagaatagatttaaaagaagctacatggagtgatttgtataaataagtcttgttagaaaaactagtgaataagagggcatagaggcataagttttaaagacacagttcatgagcataatgcagtgatagttcttaagcttattccctaactcatgtttcttcacacagcacaccctcattgcatatattaactaatactattttaagcagaaagcattgaagatgaatgcttagatcttttgtctctatactaagttttggttatgattgctatggattattgcttttgatatggatgtttactcttagaaaaatactaaaaatgtatacagtgagacatgataggcagtgattatctccaagaactgtagaggtattatcatatcagcatttctctggatcatgattgaggtttattgtcagtagtaggggaagaaataagtcatatttcatgaatgcagacactaactagcaccagatccatccaggacagtgag

SEQ ID NO: 299087 - DNA, 3339 bp, Homo sapiens
cagctttccgacatcaccagccaaggatttttttccccgctctccttagtcgccgtccgtccatcagtacctgcaggggggaggaggaggagggaggaaagcggaaagaggaaaaagcataagcttgagccttccgatccgaccacgaatactcctgtaataaacccaccgccccaacaaatctgccatagcagccgccgccgccgccggtcacttctcgtctcagcgctttctttgcttcttggtttgttgggggtagcttttatgaaacaaatctttgctattaagccacttacattttggggggttccttagagtctcccttgggggggcttctccctccctttagcccccctcggtttggaggttggattcagttggatacggcgcaaggttctgggctcctgctggcttttttttcctctctctcatcgacccccctttggttcccaccccccaccttttgcttttcgtatgtatgcatttttaaaaataaatcctgattttggaagctgagccggggaaaatgggcaacggtgattgggaccgaaggggagtctctccgtcactgttgctgggacgcgtgcctgtgctggtgtcttagagcaagagcctccctgagctttcggagtggaaggccaaatgacataggatgaaggctgttcgtaacctgctgatttatatattttccacctatctcctggttatgtttggatttaatgctgcccaagacttctggtgttcaactttggtgaagggagtcatttatggatcgtattctgtaagtgaaatgtttcctaaaaactttacaaactgcacttggacgctggaaaatccagatccaaccaaatatagcatttacctgaaattttccaaaaaggaccttagctgctctaacttttcactcctggcttatcagtttgatcatttttcccatgaaaaaataaaggatcttttaagaaagaatcattctataatgcaactctgcaattccaagaatgctttcgtttttctacagtatgataaaaattttattcaaatacgtcgagtatttccaactaatttcccaggattacagaaaaaaggggaagaagatcagaaatctttttttgagtttttggtattgaacaaggtcagcccaagccagtttggttgccatgtattatgtacttggttggagagctgcttaaaatcagaaaatgggagaacagaatcatgtgggatcatgtatacaaaatgcacctgccctcagcatttgggagagtgggggatcgacgaccagtcgctgattttgttaaataacgtggtgttacccctgaatgagcagacagagggctgcctgacccaggagctgcaaaccacccaagtctgcaatcttaccagggaggccaagcgaccacccaaagaagaatttggaatgatgggagatcatacaattaaaagtcagcgacctcgatctgttcatgaaaaaagggtccctcaggaacaagctgatgctgctaaatttatggcacaaactggtgaatctggtgtggaagagtggtcccagtggagcacatgttcggttacttgtggtcaagggtcgcaggtgcgaaccagaacttgtgtatcaccttacgggacacactgcagcggcccattaagagaatcaagggtttgcaataacactgccctctgtccagtacacggagtatgggaggaatggtcaccatggagtttatgttcatttacatgtggtcgaggccaaagaacaagaacaaggtcatgcacacctcctcagtatggaggaaggccgtgtgaaggacctgaaacacatcataagccttgtaatattgctctttgcccagttgatggacagtggcaagagtggagttcgtggagccagtgctcagtaacgtgctcgaatgggactcagcagagaagccggcagtgcactgcagctgcccatggaggctccgaatgcagagggccatgggcagaaagcagagagtgctataaccctgaatgtacagccaatggtcaatggaatcagtggggtcattggagtggttgttccaagtcctgtgatggcggctgggaaaggcgaataaggacctgtcagggtgcagtgataacagggcagcaatgtgaaggaacgggcgaagaagtgagaagatgcagtgagcagcgatgccctgcaccttatgaaatatgccctgaggattatctgatgtcgatggtgtggaaaagaactccagcaggcgacttggcattcaatcaatgtcccctgaatgccacaggcaccactagcagacgctgctctctcagtcttcatggagtggccttctgggaacagccgagctttgcaagatgcatatcaaatgagtacagacacttgcagcattcaattaaagagcaccttgctaaggggcagcgaatgctggcaggtgatggaatgtcccaggtgaccaagacactgttggatttaactcagagaaaaaatttctatgcaggcgatcttctgatgtctgtggagatcctgagaaatgtgacagacacatttaaaagggcaagttacatccctgcatctgatggtgtccagaacttctttcaaatagttagcaaccttctagatgaagaaaacaaggaaaaatgggaagatgcacaacagatttatccagggtcaatagagttaatgcaggtgattgaagattttatacacattgttggaatggggatgatggactttcagaattcatacttaatgactggaaatgtaggtaagaaataggattttcccccaaaatctttctgaaataaaaaaaaattgcaagtatctacaccatacgtttccaagtataatattcattattcatatgtttaactgcatgtgagcaaatatatttctaatacttggtatctgacttttagatgggcctaaacacattgcattatatatatgtacacgtatatttgtatttatcttcatgcatttgtatgattgcttgtaggcctatttttgtgtatctttacatgtatatgtaggataatatgtatttattttttcattctgccaaatgctcattgctatctaatctagttatgaatgtgtgtgtgtgtatacacactagtaattttgaaaaacaacatattagtctttatgatcttccgtacattgttcttgaggatgccgagttactttctcactgattgtcccaggcaggagctgaatctgtgtgtggtagaacacttgagaataacttccagggttaagatgatggtgcaactgctgccaatgcagtttttctgaatatgttccagtacacagtggatctctcaggtccctctgagtggattctg

SEQ ID NO: 299088 - DNA, 970 bp, Homo sapiens
aggtgattttctgagtgtgactcctctgttcctggcaccctgtgcatccttagccatagcttacaagagaacagctggttgtgatggcaggaggccctcccaacaccaaggcggagatggaaatgtccctggcagaagaactgaatcatggacgccaaggggaaaaccaagagcacctggtgatagcagaaatgatggagcttggatctcggtcccggggtgcctcccagaagaagcagaagttggaacaaaaagctgctggctctgcttcagccaaacgagtttggaatatgactgccacccgacccaagaaaatgcaacccagggacagatgcagtggcgcagactagcctggaagagttcaatgtactggagatggaagtcatgagaagacagctgtatgcagtcaaccggcgtctgcgcgccctggaggaacagggcgccacctggcgccacagggagaccctgatcatcgccgtgctggtgtcggccagcattgccaacctgtggctgtggatgaaccagtgatcgccccagcgcggcctccgtattggagccctccctgcttccccttctttctttcctctttccccaggccgccactgcccttgcccctttcatctcccagcagccctcaggagcgtcaggatcattttcaactctggttaggcctcctacctggggaggccaggtcactgcactgggaggtcctggctgctgcgaagctggaggaggactgcgtgggctgagatgccaccctttgaagggtgaacagcatggcggcatctgggccccacagtaacacctagtggcaaccttgccttcctgacctcagcggcccttctgttccatcctctgtgggcaggggtgtggctttgttttcctccctcgtttgcttccacctcgtgcacagcgctctgcacagacaacacgctcaataaaagttcagccatagcagcaaaaacctgtg

SEQ ID NO: 299089 - DNA, 1077 bp, Homo sapiens
aggtgattttctgagtgtgactcctctgttcctggcaccctgtgcatccttagccatagcttacaagagaacagctggttgtgatggcaggaggccctcccaacaccaaggcggagatggaaatgtccctggcagaagaactgaatcatggacgccaaggggaaaaccaagagcacctggtgatagcagaaatgatggagcttggatctcggtcccggggtgcctcccagaagaagcagaagttggaacaaaaagctgctggctctgcttcagccaaacgagtttggaatatgactgccacccgacccaagaaaatggggtcccagctgccaaagcccagaatgctgagagaatcaggccatggggatgcccatctccaggagtacgctggcaatttccaaggcatacgtttccattatgatcgcaacccagggacagatgcagtggcgcagactagcctggaagagttcaatgtactggagatggaagtcatgagaagacagctgtatgcagtcaaccggcgtctgcgcgccctggaggaacagggcgccacctggcgccacagggagaccctgatcatcgccgtgctggtgtcggccagcattgccaacctgtggctgtggatgaaccagtgatcgccccagcgcggcctccgtattggagccctccctgcttccccttctttctttcctctttccccaggccgccactgcccttgcccctttcatctcccagcagccctcaggagcgtcaggatcattttcaactctggttaggcctcctacctggggaggccaggtcactgcactgggaggtcctggctgctgcgaagctggaggaggactgcgtgggctgagatgccaccctttgaagggtgaacagcatggcggcatctgggccccacagtaacacctagtggcaaccttgccttcctgacctcagcggcccttctgttccatcctctgtgggcaggggtgtggctttgttttcctccctcgtttgcttccacctcgtgcacagcgctctgcacagacaacacgctcaataaaagttcagccatagcagcaaaaacctgtg

SEQ ID NO: 299090 - DNA, 1030 bp, Homo sapiens
aggtgattttctgagtgtgactcctctgttcctggcaccctgtgcatccttagccatagcttacaagagaacagctggttgtgatggcaggaggccctcccaacaccaaggcggagatggaaatgtccctggcagaagaactgaatcatggacgccaaggggaaaaccaagagcacctggtgatagcagaaatgatggagcttggatctcggtcccggggtgcctcccagaagaagcagaagttggaacaaaaagctgctggctctgcttcagccaaacgagtttggaatatgactgccacccgacccaagaaaatgggatgcccatctccaggagtacgctggcaatttccaaggcatacgtttccattatgatcgcaacccagggacagatgcagtggcgcagactagcctggaagagttcaatgtactggagatggaagtcatgagaagacagctgtatgcagtcaaccggcgtctgcgcgccctggaggaacagggcgccacctggcgccacagggagaccctgatcatcgccgtgctggtgtcggccagcattgccaacctgtggctgtggatgaaccagtgatcgccccagcgcggcctccgtattggagccctccctgcttccccttctttctttcctctttccccaggccgccactgcccttgcccctttcatctcccagcagccctcaggagcgtcaggatcattttcaactctggttaggcctcctacctggggaggccaggtcactgcactgggaggtcctggctgctgcgaagctggaggaggactgcgtgggctgagatgccaccctttgaagggtgaacagcatggcggcatctgggccccacagtaacacctagtggcaaccttgccttcctgacctcagcggcccttctgttccatcctctgtgggcaggggtgtggctttgttttcctccctcgtttgcttccacctcgtgcacagcgctctgcacagacaacacgctcaataaaagttcagccatagcagcaaaaacctgtg

SEQ ID NO: 299091 - DNA, 977 bp, Homo sapiens
gggggtgtggactaagccagctttgaaaggcatttggggtctcagcagtgggatactatttaaggctaagggtatgtagtttattcagtagaaaccaagtgcttattttctctctgaggttctgcattagatttgatgactctttttctgcctccaaaggcttgtaaataaggggaaattctcatcaagcaatccacaaacttgaggagaaacacagatattggaataattccctccgcatgaagcaggtgtattgataaaaacgccagcaactgctgctggagcccctgtgaaattcccagtcatttattttcacttttttttctcctttcagcatggcagggggcttgagatattcctttttaacactgagcagccagttaaaacctaaacctgtgggtgaagaaaacatctgtttggatttgaagagctaaagagtctgcagcaggattggagactgacttgtgactgcgggctgggggggcattcccagtaggaatgtgaagccagaggtttcggattcgtgacatccaccccctgggcaagtgagagcatctgcaaaatgcaaagagaactacctcatatgcaggatgagccaatggcagtctcaagaaatgtactcgggcgacaccttacctgtggaaagcaaatcttttcaaaataagccactgggactcggtaggtggagccccagctgctcttctagggacctatggggccttcgtggcatctctgtgctgtgtgctggggaggaggttgatgtaatggtgactcttttctgatcagcaccttggccgtgattcccaaggtcccagccaaagcaaagggccagttgtttcagtttaaacagacatgtctttagtctaataaaattagttaactgccagtaaagttatttgttagctttgatgaaagctatgttggtatctttccctaatcatcaaagtaaataaaaaatcatttctaaaaaaaaaaaa

SEQ ID NO: 299092 - DNA, 1283 bp, Homo sapiens
agcgggaccagtgcgcagccggggctggcgggcggcggggtccgcggggccgcaggagatgacggccggcggccaggccgaggccgagggcgctggcggggagcccggcgcggcgcggctgccctcgcgggtggcccggctgctgtcggcgctcttctacgggacctgctccttcctcatcgtgcttgtcaacaaggcgctgctgaccacctacggtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggaagcagtattcactcaacatcatcctcagtgtctttgccattattctcggggctttcatagcagctgggtaagactttggactgtttctgctcaataacttctttgtgtctttgacaataggcccagccccatcctcagtttttcattttccatctggctgctgttgaattgagcaggcaagagacaaatctgttgaagttagtggaatccccatgtgttcctatgaaagtcaaagtgggtcccacattggccagaaaatttctgagaatatatgaagagagcattgcaagatattaatatagcttttcttcacaaaaagcagtgaactgtttacatttcttactgaatgtttgtcttcattataacaactttacttgagaagttcttaggcatttgattaataataacagacttacaaagcctttgtctgctgatttattttattattccatgataccttagcagttgctgtttccgatggtagaatgctaaatatatttgtacgtttgggatatgagccaacactggtgcatgactactactttaataattattttgcaaaaggaataacgaggactccaagtcttcgtgggcaggcaggtgctcagatttctgctatagcatggtggatagtgcatgtgaatagttacatccctgggttcaaaacttagctccaggctgggtgtggtggctcacccctataatcccagcactgtaggaagcctaggtgggaatatcacctgagcccatgagtttgagataagcttgggaaacattgtgagaacctatttctacaaaaaaaaa

SEQ ID NO: 299093 - DNA, 997 bp, Homo sapiens
tgcttaagaaataatgtaaatttagtctgacttagaaacacttttagtgctttctctgcatcaagcattgtctgctggattttagctataaaaatgctgatgtctattttcaatttgtttaaaaaatataatcatatttcaatgttttcctctctgctccctttcctttcttatttgtgtatttattacaggaagcagtattcactcaacatcatcctcagtgtctttgccattattctcggggctttcatagcagctgggtaagactttggactgtttctgctcaataacttctttgtgtctttgacaataggcccagccccatcctcagtttttcattttccatctggctgctgttgaattgagcaggcaagagacaaatctgttgaagttagtggaatccccatgtgttcctatgaaagtcaaagtgggtcccacattggccagaaaatttctgagaatatatgaagagagcattgcaagatattaatatagcttttcttcacaaaaagcagtgaactgtttacatttcttactgaatgtttgtcttcattataacaactttacttgagaagttcttaggcatttgattaataataacagacttacaaagcctttgtctgctgatttattttattattccatgataccttagcagttgctgtttccgatggtagaatgctaaatatatttgtacgtttgggatatgagccaacactggtgcatgactactactttaataattattttgcaaaaggaataacgaggactccaagtcttcgtgggcaggcaggtgctcagatttctgctatagcatggtggatagtgcatgtgaatagttacatccctgggttcaaaacttagctccaggctgggtgtggtggctcacccctataatcccagcactgtaggaagcctaggtgggaatatcacctgagcccatgagtttgagataagcttgggaaacattgtgagaacctatttctacaaaaaaaaa

SEQ ID NO: 299094 - DNA, 1507 bp, Homo sapiens
agcgggaccagtgcgcagccggggctggcgggcggcggggtccgcggggccgcaggagatgacggccggcggccaggccgaggccgagggcgctggcggggagcccggcgcggcgcggctgccctcgcgggtggcccggctgctgtcggcgctcttctacgggacctgctccttcctcatcgtgcttgtcaacaaggcgctgctgaccacctacggtttcaagcatactgaaaacgggaaagcaaaggaggagtgaacagggcacacacagtactgggattcccctccagcctttgaaatttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagtgatggggtctttcaatgttgctgtgttacccagactcaaatgcagtagctttcactggtgcaatcatggctcactgtggcctcaaactcctgggctcaaatgattctccacctcagcctctcgagtacctgggactgcagcctaccgatgttcaccgtgctcaggaaattcaccattccacttaccttacttctggaaaccatcatacttgggaagcagtattcactcaacatcatcctcagtgtctttgccattattctcggggctttcatagcagctgggtaagactttggactgtttctgctcaataacttctttgtgtctttgacaataggcccagccccatcctcagtttttcattttccatctggctgctgttgaattgagcaggcaagagacaaatctgttgaagttagtggaatccccatgtgttcctatgaaagtcaaagtgggtcccacattggccagaaaatttctgagaatatatgaagagagcattgcaagatattaatatagcttttcttcacaaaaagcagtgaactgtttacatttcttactgaatgtttgtcttcattataacaactttacttgagaagttcttaggcatttgattaataataacagacttacaaagcctttgtctgctgatttattttattattccatgataccttagcagttgctgtttccgatggtagaatgctaaatatatttgtacgtttgggatatgagccaacactggtgcatgactactactttaataattattttgcaaaaggaataacgaggactccaagtcttcgtgggcaggcaggtgctcagatttctgctatagcatggtggatagtgcatgtgaatagttacatccctgggttcaaaacttagctccaggctgggtgtggtggctcacccctataatcccagcactgtaggaagcctaggtgggaatatcacctgagcccatgagtttgagataagcttgggaaacattgtgagaacctatttctacaaaaaaaaa

SEQ ID NO: 299095 - DNA, 1615 bp, Homo sapiens
agcgggaccagtgcgcagccggggctggcgggcggcggggtccgcggggccgcaggagatgacggccggcggccaggccgaggccgagggcgctggcggggagcccggcgcggcgcggctgccctcgcgggtggcccggctgctgtcggcgctcttctacgggacctgctccttcctcatcgtgcttgtcaacaaggcgctgctgaccacctacggtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggaagcagtattcactcaacatcatcctcagtgtctttgccattattctcggggctttcatagcagctgggtctgaccttgcttttaacttagaaggctatatttttgtattcctgaatgatatcttcacagcagcaaatggagtttataccaaacagaaaatggacccaaaggagctagggaaatacggagtacttttctacaatgcctgcttcatgattatcccaactcttattattagtgtctccactggagacctgcaacaggctactgaattcaaccaatggaagaatgttgtgtttatcctacagtttcttctttcctgttttttggggtttctgctgatgtactccacggttctgtgcagctattacaattcagccctgacgacagcagtggttggagccatcaagaatgtatccgttgcctacattgggatattaatcggtggagactacattttctctttgttaaactttgtagggttaaatatttgcatggcagggggcttgagatattcctttttaacactgagcagccagttaaaacctaaacctgtgggtgaagaaaacatctgtttggatttgaagagctaaagagtctgcagcaggattggagactgacttgtgactgcgggctgggggggcattcccagtaggaatgtgaagccagaggtttcggattcgtgacatccaccccctgggcaagtgagagcatctgcaaaatgcaaagagaactacctcatatgcaggatgagccaatggcagtctcaagaaatgtactcgggcgacaccttacctgtggaaagcaaatcttttcaaaataagccactgggactcggtaggtggagccccagctgctcttctagggacctatggggccttcgtggcatctctgtgctgtgtgctggggaggaggttgatgtaatggtgactcttttctgatcagcaccttggccgtgattcccaaggtcccagccaaagcaaagggccagttgtttcagtttaaacagacatgtctttagtctaataaaattagttaactgccagtaaagttatttgttagctttgatgaaagctatgttggtatctttccctaatcatcaaagtaaataaaaaatcatttctaaaaaaaaaaaa

SEQ ID NO: 299096 - DNA, 2772 bp, Homo sapiens
agcgggaccagtgcgcagccggggctggcgggcggcggggtccgcggggccgcaggagatgacggccggcggccaggccgaggccgagggcgctggcggggagcccggcgcggcgcggctgccctcgcgggtggcccggctgctgtcggcgctcttctacgggacctgctccttcctcatcgtgcttgtcaacaaggcgctgctgaccacctacggtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggaagcagtattcactcaacatcatcctcagtgtctttgccattattctcggggctttcatagcagctgggtctgaccttgcttttaacttagaaggctatatttttgtattcctgaatgatatcttcacagcagcaaatggagtttataccaaacagaaaatggacccaaaggagctagggaaatacggagtacttttctacaatgcctgcttcatgattatcccaactcttattattagtgtctccactggagacctgcaacaggctactgaattcaaccaatggaagaatgttgtgtttatcctacagtttcttctttcctgttttttggggtttctgctgatgtactccacggttctgtgcagctattacaattcagccctgacgacagcagtggttggagccatcaagaatgtatccgttgcctacattgggatattaatcggtggagactacattttctctttgttaaactttgtagggttaaatatttgcatggcagggggcttgagatattcctttttaacactgagcagccagttaaaacctaaacctgtgggtgaagaaaacatctgtttggatttgaagagctaaagagtctgcagcaggattggagactgacttgtgactgcgggctgggggggcattcccagtaggaatgtgaagccagaggtttcggattcgtgacatccaccccctgggcaagtgagagcatctgcaaaatgcaaagagaactacctcatatgcaggatgagccaatggcagtctcaagaaatgtactcgggcgacaccttacctgtggaaagcaaatcttttcaaaataagccactgggactcgctcgacttggtggaagttctgcctcaggtgggcatagccaaaaaggggtcattctcttctcggttcctggggaattggatccaactgggagaagaccacctgaattctcatcccatctaagttgaagatgctattttttaaaaatttaatttgtaattttaagttctgggatacatgtgcaggatgtgcaggtttgttacataggtaaatgtgtgccctggtggtttgctgcacctatcaacctatcacctaggtattaagccccacatgcattagctatttatcctgatgctccctctcccgcacccccctaacaggccccagtgtgtgttgttcccctccctgtgtccatgtattctcattgttcagctcccacttataagtgaaaacatgcagtgtttggttttctgttcctgtgttagtttgctgaggataatggcttctagctccatccatgtccctgcaatggacatgatctcgttccttttgatggctgcatagtattccgtggtgtgtatgtaccatgttttctttatccagtctatcatagatgggcatttgggttgattccatgtttttgctgttgtgaatagtgctgcagtgaacatacacatgcttgtatctttatttttaaaaatctttttttttgaagacagggtctggctctgttgcccaggcaggagtacagtggcattatctcagctcactgcaaccactgcctcccaggctcaagtgatctgccctcctcagcctcctaagtagctgagaccacagggacacaccattacacctggctaattgttgtattttagtagagatgggatctttctatgttgcctaggctggcctcaagtgatcctcctgccttggcctcccaaagtgctgtgattacaggtgtgaaccaccatgcccagccagagatgctcaattcctggtgagtgcagctgaggggctagggccctctctaccaagcccctacccattagatgcaggctctacctcaagtacagcaggccacaaatactggggtccccattacccttgccccagctcacttggaaggctgttccacactggggagagatgatctgacaagaccagaggctaccaccctgtccagcacccagacgagtggctcagagaggctgcccagggaggacgcagcctgtgcagtaaagaatttaatcttgcccaaaaagatgtctggtctttgccctaagcttcttggaatatcatgccaaagaggagtgtctttgtttgcctggggaccttgggttacattagatagtctaacaatgtgatttcagatgggggctggctacaccagaaagaccaacagggtggtttagggtgaaggctttgggtgatacctggggagtctggagacagagatcagccatgtgggcaatcagtgaagtttatgtaatgaagccctaataaaaactctgaacactga

SEQ ID NO: 299097 - DNA, 1532 bp, Homo sapiens
agcgggaccagtgcgcagccggggctggcgggcggcggggtccgcggggccgcaggagatgacggccggcggccaggccgaggccgagggcgctggcggggagcccggcgcggcgcggctgccctcgcgggtggcccggctgctgtcggcgctcttctacgggacctgctccttcctcatcgtgcttgtcaacaaggcgctgctgaccacctacggtttcccgtcaccaattttccttggaattggacagatggcagccaccataatgatactatatgtgtccaagctaaacaaaatcattcacttccctgattttgataagaaaattcctgtaaagctgtttcctctgcctctcctctacgttggaaaccacataagtggattatcaagcacaagtaaattaagcctaccgatgttcaccgtgctcaggaaattcaccattccacttaccttacttctggaaaccatcatacttgggaagcagtattcactcaacatcatcctcagtgtctttgccattattctcggggctttcatagcagctgggtctgaccttgcttttaacttagaaggctatatttttgtattcctgaatgatatcttcacagcagcaaatggagtttataccaaacagaaaatggacccaaaggagctagggaaatacggagtacttttctacaatgcctgcttcatgattatcccaactcttattattagtgtctccactggagacctgcaacaggctactgaattcaaccaatggaagaatgttgtgtttatcctacagtttcttctttcctgttttttggggtttctgctgatgtactccacggttctgtgcagctattacaattcagccctgacgacagcagtggttggagccatcaagcatggcagggggcttgagatattcctttttaacactgagcagccagttaaaacctaaacctgtgggtgaagaaaacatctgtttggatttgaagagctaaagagtctgcagcaggattggagactgacttgtgactgcgggctgggggggcattcccagtaggaatgtgaagccagaggtttcggattcgtgacatccaccccctgggcaagtgagagcatctgcaaaatgcaaagagaactacctcatatgcaggatgagccaatggcagtctcaagaaatgtactcgggcgacaccttacctgtggaaagcaaatcttttcaaaataagccactgggactcggtaggtggagccccagctgctcttctagggacctatggggccttcgtggcatctctgtgctgtgtgctggggaggaggttgatgtaatggtgactcttttctgatcagcaccttggccgtgattcccaaggtcccagccaaagcaaagggccagttgtttcagtttaaacagacatgtctttagtctaataaaattagttaactgccagtaaagttatttgttagctttgatgaaagctatgttggtatctttccctaatcatcaaagtaaataaaaaatcatttctaaaaaaaaaaaa

SEQ ID NO: 299098 - DNA, 389 bp, Homo sapiens
gtgtccaagctaaacaaaatcattcacttccctgattttgataagaaaattcctgtaaaggtaagtaatgaaaagtatgtatgactgtgatagaagatgtgaaaatacacattgattttagagtacaggtcaatttctatacacactgtacttcctgcctgcactggatagaaacttctttttttgtttgagatggactgtcgctctgtcgcccaggctggagtgcaatggtgtgatcttggctcactgcaatctccgcctcctgggttcaagtgattctcgtgcctcagcctccctagtagctgggattacaggtgcctgccaccattcccagctaattttttttgttttgttttgtttttgtatttttagtagagatggggtttcac

SEQ ID NO: 299099 - DNA, 383 bp, Homo sapiens
ctcgaattcaagcttctaacgatgtacggggacatggtggcgtgtgcctgtaatctcagctactcaggaggctgaggcaggagaatcgcttgaacccaggaggcggaggctgcagtgagctgagattgtgccactgcactccagcctgggagacagagcaagactcagtctcaaaaaaaaaaaaaaaaagcatttttctgttttaatgtttggagacttttttttttgttctctccctttcctgaaccctattctgatcctgaaccaaatttatagcaatataattagtgttaatctaaggcattactcatcaaaaaaattgctgcagtctttacagttgaataaataaaaacaactgcataaatatgcccacaaaaatttca

SEQ ID NO: 299100 - DNA, 1311 bp, Homo sapiens
atctgctggatctccggcagcatcctgcagtccggcccaggagagaagtggggaggcggcggtgggggcggggcggcgtccggctctgagagagctgggggaggagcgcggcggcgacggcggcggtggctctagaaggggaggtggaggatctcctttcctcttctcagacccgggagcgtccgggacgcggagcccggagctggggcgacgaggcgattgcgggggcctgggctagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaaggtaaaatgaattacatttaaaagcatgatgatgtgtatattatttttaaaaatttaggctctgcaaaaatatttgaaagaaaaggttcacatacatatcttctgtttacctggttaaaaaacatctttggccaggtgcaggggctcacacctgtaatcccagcactttaggaggccaaggcaggtggatcacttgaggtcagtggttcaagactagcccggccaacatggtgaagtcccgtctctactaaaaaatagaaaaaattagccaggtgtggtggcacgtgcctgtaatcccagttactcaggagggtgaggcaggagaataacttgaacccaagaggcagaggttgcagtgagccgagattgggccactgcattccagcctgggtgacagattgagactccatctccaaaaaaaaaaaaaaattcttcgaccttgaaacatagctgtgtctcacagagtaccacacagtcctctccgtgtgatttaaggcaggaaacagaatgactttgccatggtgcagttattagacgggtgaaaaagacagcaaatcaaggaaagca

SEQ ID NO: 299101 - DNA, 687 bp, Homo sapiens
atctgctggatctccggcagcatcctgcagtccggcccaggagagaagtggggaggcggcggtgggggcggggcggcgtccggctctgagagagctgggggaggagcgcggcggcgacggcggcggtggctctagaaggggaggtggaggatctcctttcctcttctcagacccgggagcgtccgggacgcggagcccggagctggggcgacgaggcgattgcgggggcctgggctagctgctggctaccaatattctactttctgtctctatgaatgtgactaccctggttacctcatataatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacatccagcctgggagacagagcaagactcagtctcaaaaaaaaaaaaaaaaagcatttttctgttttaatgtttggagacttttttttttgttctctccctttcctgaaccctattctgatcctgaaccaaatttatagcaatataattagtgttaatctaaggcattactcatcaaaaaaattgctgcagtctttacagttgaataaataaaaacaactgcataaatatgcccacaaaaatttca

SEQ ID NO: 299102 - DNA, 925 bp, Homo sapiens
atctgctggatctccggcagcatcctgcagtccggcccaggagagaagtggggaggcggcggtgggggcggggcggcgtccggctctgagagagctgggggaggagcgcggcggcgacggcggcggtggctctagaaggggaggtggaggatctcctttcctcttctcagacccgggagcgtccgggacgcggagcccggagctggggcgacgaggcgattgcgggggcctgggctagctgctggctaccaatattctactttctgtctctatgaatgtgactaccctggttacctcatatttatttgcagtgacttaaaatttggaggcaaattttccttaagaggatatcaagttccagtatcttcagatgttgataagccgttagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaagggaaggagagcgcgagtgaacaaggaaggaactggagggcatgagtgctggaaccggctggctgcttcagtaccagcaggggtgaactctgtgtgggccccgtggcagcatccaggctgtggggtgcctgtgacccccgaagctccagagggcatgttacagtgctcttctggctctgcctttgtggacggcttaagtgttaacagctcagtgggccctttccccccgtgtgtggggtggctgccctctgccagcaagggcaaagggcca

SEQ ID NO: 299103 - DNA, 208 bp, Homo sapiens
caccacaaagcaaaaccgatatggtaaggaaaattattttcatccagaggttgaatactagggtactactgtctccttatacattgaaggctgtgggctcttttataacaacatggaaaagctttatgtgcctataaaccatttatatttgcagtggaaaaaattctaattgcctatttaatgttctttttctgtaaaaagcctacca

SEQ ID NO: 299104 - DNA, 3364 bp, Homo sapiens
atctgctggatctccggcagcatcctgcagtccggcccaggagagaagtggggaggcggcggtgggggcggggcggcgtccggctctgagagagctgggggaggagcgcggcggcgacggcggcggtggctctagaaggggaggtggaggatctcctttcctcttctcagacccgggagcgtccgggacgcggagcccggagctggggcgacgaggcgattgcgggggcctgggctagctgctggctaccaatattctactttctgtctctatgaatgtgactaccctggttacctcatataatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggatagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctgtttaatggatcgagaagtggcgttgcttgctgaaatggacaaagtgaaagctgaagcaatggaaattttgctcagccgacaaaagaaggctgaacttctaaagaagatgactcatgtggctgttcaaatgtcagagcagcaattggttgagctcagagctgatatcaagcactttgttagtgaacgtaaatatgatgaggatctgggacgagtagcccggttcacctgtgatgtagagaccctaaagaagagcattgattcatttggacaagtgtctcatccaaagaacagctattcgaccagatcccgatgtagctcagttacatctgtgtccttgagtagcccaagtgatgcctctgctgcttcctcttccacctgtgcctctcctcccagccttacaagtgctaacaagaaaaactttgcaccgggagagactcctgcagccatagcaaactccagtggccagccctaccagccacttcgggaggtattgccagggaacagacgaggaggacagggctataggccacaaggccaaaagtccaatgaccccatgaaccaagggcggcatgacagtatgggtcgttacagaaacagctcgtggtattcatctggttccaggtatcagagtgctccatctcaggcaccaggaaacaccattgaaagaggccagactcactctgcagggaccaatggaactggagtcagcatggagcccagccctcccacgccttcattcaaaaaggggctcccccagcgcaaacccaggacctctcagactgaagccgtgaactcttgagagaaaatccagttggcctctctcctctatccacacaattcaacttgataactggactttaggaaacttacagttagatgtaataacaaaaagaagtttatgcgtatcactttttgtgccattctaagtatttttggtttcttgtctccttatttcctctttaccatttttggaggggaagctattttttttccttgatctttcccagtgatatggattgaatctggttggtcatttccaccaggaatcagaggcagctgttaccaggtttcggccttccagttgatccctccactgtccaggctgtctcaggaggaggtgaatcagagctagtctgtcacctttccaatctaagccgaagccacaggtgcctgacaggttcccttctaacaactatttgaccaagagaggcaatcagggggttgtatactgcactggattcgccagagaagggaaaatttaattagtgaaaaggaaagaacactaggaaacatttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtgaaaccctgtctgtactaaaaatacaaaagttagctgagcatggtggcgtgtgcctgtaatctcagctactcaggaggctgaggcaggagaatcgcttgaacccaggaggcggaggctgcagtgagctgagattgtgccactgcactccagcctgggagacagagcaagactcagtctcaaaaaaaaaaaaaaaaagcatttttctgttttaatgtttggagacttttttttttgttctctccctttcctgaaccctattctgatcctgaaccaaatttatagcaatataattagtgttaatctaaggcattactcatcaaaaaaattgctgcagtctttacagttgaataaataaaaacaactgcataaatatgcccacaaaaatttca

SEQ ID NO: 299105 - DNA, 3158 bp, Homo sapiens
gcgcgcgccgggtccctaaccgatgccgccggctgctggctaccaatattctactttctgtctctatgaatgtgactaccctggttacctcatataatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggatagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctgtttaatggatcgagaagtggcgttgcttgctgaaatggacaaagtgaaagctgaagcaatggaaattttgctcagccgacaaaagaaggctgaacttctaaagaagatgactcatgtggctgttcaaatgtcagagcagcaattggttgagctcagagctgatatcaagcactttgttagtgaacgtaaatatgatgaggatctgggacgagtagcccggttcacctgtgatgtagagaccctaaagaagagcattgattcatttggacaagtgtctcatccaaagaacagctattcgaccagatcccgatgtagctcagttacatctgtgtccttgagtagcccaagtgatgcctctgctgcttcctcttccacctgtgcctctcctcccagccttacaagtgctaacaagaaaaactttgcaccgggagagactcctgcagccatagcaaactccagtggccagccctaccagccacttcgggaggtattgccagggaacagacgaggaggacagggctataggccacaaggccaaaagtccaatgaccccatgaaccaagggcggcatgacagtatgggtcgttacagaaacagctcgtggtattcatctggttccaggtatcagagtgctccatctcaggcaccaggaaacaccattgaaagaggccagactcactctgcagggaccaatggaactggagtcagcatggagcccagccctcccacgccttcattcaaaaaggggctcccccagcgcaaacccaggacctctcagactgaagccgtgaactcttgagagaaaatccagttggcctctctcctctatccacacaattcaacttgataactggactttaggaaacttacagttagatgtaataacaaaaagaagtttatgcgtatcactttttgtgccattctaagtatttttggtttcttgtctccttatttcctctttaccatttttggaggggaagctattttttttccttgatctttcccagtgatatggattgaatctggttggtcatttccaccaggaatcagaggcagctgttaccaggtttcggccttccagttgatccctccactgtccaggctgtctcaggaggaggtgaatcagagctagtctgtcacctttccaatctaagccgaagccacaggtgcctgacaggttcccttctaacaactatttgaccaagagaggcaatcagggggttgtatactgcactggattcgccagagaagggaaaatttaattagtgaaaaggaaagaacactaggaaacatttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtgaaaccctgtctgtactaaaaatacaaaagttagctgagcatggtggcgtgtgcctgtaatctcagctactcaggaggctgaggcaggagaatcgcttgaacccaggaggcggaggctgcagtgagctgagattgtgccactgcactccagcctgggagacagagcaagactcagtctcaaaaaaaaaaaaaaaaagcatttttctgttttaatgtttggagacttttttttttgttctctccctttcctgaaccctattctgatcctgaaccaaatttatagcaatataattagtgttaatctaaggcattactcatcaaaaaaattgctgcagtctttacagttgaataaataaaaacaactgcataaatatgcccacaaaaatttca

SEQ ID NO: 299106 - DNA, 3464 bp, Homo sapiens
atctgctggatctccggcagcatcctgcagtccggcccaggagagaagtggggaggcggcggtgggggcggggcggcgtccggctctgagagagctgggggaggagcgcggcggcgacggcggcggtggctctagaaggggaggtggaggatctcctttcctcttctcagacccgggagcgtccgggacgcggagcccggagctggggcgacgaggcgattgcgggggcctgggctagagctgaggtcactagtgaactctgcttccaagtactcctgcaaagtacaccacaagcctgtctatattctcaagccatccgcttcagttcatatgaccacacttgcatgtcagcaacagaagagaacacacatcatacagcatttacagcagtggacaaagagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggatagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctgtttaatggatcgagaagtggcgttgcttgctgaaatggacaaagtgaaagctgaagcaatggaaattttgctcagccgacaaaagaaggctgaacttctaaagaagatgactcatgtggctgttcaaatgtcagagcagcaattggttgagctcagagctgatatcaagcactttgttagtgaacgtaaatatgatgaggatctgggacgagtagcccggttcacctgtgatgtagagaccctaaagaagagcattgattcatttggacaagtgtctcatccaaagaacagctattcgaccagatcccgatgtagctcagttacatctgtgtccttgagtagcccaagtgatgcctctgctgcttcctcttccacctgtgcctctcctcccagccttacaagtgctaacaagaaaaactttgcaccgggagagactcctgcagccatagcaaactccagtggccagccctaccagccacttcgggaggtattgccagggaacagacgaggaggacagggctataggccacaaggccaaaagtccaatgaccccatgaaccaagggcggcatgacagtatgggtcgttacagaaacagctcgtggtattcatctggttccaggtatcagagtgctccatctcaggcaccaggaaacaccattgaaagaggccagactcactctgcagggaccaatggaactggagtcagcatggagcccagccctcccacgccttcattcaaaaaggggctcccccagcgcaaacccaggacctctcagactgaagccgtgaactcttgagagaaaatccagttggcctctctcctctatccacacaattcaacttgataactggactttaggaaacttacagttagatgtaataacaaaaagaagtttatgcgtatcactttttgtgccattctaagtatttttggtttcttgtctccttatttcctctttaccatttttggaggggaagctattttttttccttgatctttcccagtgatatggattgaatctggttggtcatttccaccaggaatcagaggcagctgttaccaggtttcggccttccagttgatccctccactgtccaggctgtctcaggaggaggtgaatcagagctagtctgtcacctttccaatctaagccgaagccacaggtgcctgacaggttcccttctaacaactatttgaccaagagaggcaatcagggggttgtatactgcactggattcgccagagaagggaaaatttaattagtgaaaaggaaagaacactaggaaacatttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtgaaaccctgtctgtactaaaaatacaaaagttagctgagcatggtggcgtgtgcctgtaatctcagctactcaggaggctgaggcaggagaatcgcttgaacccaggaggcggaggctgcagtgagctgagattgtgccactgcactccagcctgggagacagagcaagactcagtctcaaaaaaaaaaaaaaaaagcatttttctgttttaatgtttggagacttttttttttgttctctccctttcctgaaccctattctgatcctgaaccaaatttatagcaatataattagtgttaatctaaggcattactcatcaaaaaaattgctgcagtctttacagttgaataaataaaaacaactgcataaatatgcccacaaaaatttca

SEQ ID NO: 299107 - DNA, 3301 bp, Homo sapiens
atctgctggatctccggcagcatcctgcagtccggcccaggagagaagtggggaggcggcggtgggggcggggcggcgtccggctctgagagagctgggggaggagcgcggcggcgacggcggcggtggctctagaaggggaggtggaggatctcctttcctcttctcagacccgggagcgtccgggacgcggagcccggagctggggcgacgaggcgattgcgggggcctgggctagaatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggatagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctgtttaatggatcgagaagtggcgttgcttgctgaaatggacaaagtgaaagctgaagcaatggaaattttgctcagccgacaaaagaaggctgaacttctaaagaagatgactcatgtggctgttcaaatgtcagagcagcaattggttgagctcagagctgatatcaagcactttgttagtgaacgtaaatatgatgaggatctgggacgagtagcccggttcacctgtgatgtagagaccctaaagaagagcattgattcatttggacaagtgtctcatccaaagaacagctattcgaccagatcccgatgtagctcagttacatctgtgtccttgagtagcccaagtgatgcctctgctgcttcctcttccacctgtgcctctcctcccagccttacaagtgctaacaagaaaaactttgcaccgggagagactcctgcagccatagcaaactccagtggccagccctaccagccacttcgggaggtattgccagggaacagacgaggaggacagggctataggccacaaggccaaaagtccaatgaccccatgaaccaagggcggcatgacagtatgggtcgttacagaaacagctcgtggtattcatctggttccaggtatcagagtgctccatctcaggcaccaggaaacaccattgaaagaggccagactcactctgcagggaccaatggaactggagtcagcatggagcccagccctcccacgccttcattcaaaaaggggctcccccagcgcaaacccaggacctctcagactgaagccgtgaactcttgagagaaaatccagttggcctctctcctctatccacacaattcaacttgataactggactttaggaaacttacagttagatgtaataacaaaaagaagtttatgcgtatcactttttgtgccattctaagtatttttggtttcttgtctccttatttcctctttaccatttttggaggggaagctattttttttccttgatctttcccagtgatatggattgaatctggttggtcatttccaccaggaatcagaggcagctgttaccaggtttcggccttccagttgatccctccactgtccaggctgtctcaggaggaggtgaatcagagctagtctgtcacctttccaatctaagccgaagccacaggtgcctgacaggttcccttctaacaactatttgaccaagagaggcaatcagggggttgtatactgcactggattcgccagagaagggaaaatttaattagtgaaaaggaaagaacactaggaaacatttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtgaaaccctgtctgtactaaaaatacaaaagttagctgagcatggtggcgtgtgcctgtaatctcagctactcaggaggctgaggcaggagaatcgcttgaacccaggaggcggaggctgcagtgagctgagattgtgccactgcactccagcctgggagacagagcaagactcagtctcaaaaaaaaaaaaaaaaagcatttttctgttttaatgtttggagacttttttttttgttctctccctttcctgaaccctattctgatcctgaaccaaatttatagcaatataattagtgttaatctaaggcattactcatcaaaaaaattgctgcagtctttacagttgaataaataaaaacaactgcataaatatgcccacaaaaatttca

SEQ ID NO: 299108 - DNA, 3310 bp, Homo sapiens
atctgctggatctccggcagcatcctgcagtccggcccaggagagaagtggggaggcggcggtgggggcggggcggcgtccggctctgagagagctgggggaggagcgcggcggcgacggcggcggtggctctagaaggggaggtggaggatctcctttcctcttctcagacccgggagcgtccgggacgcggagcccggagctggggcgacgaggcgattgcgggggcctgggctagctgctggctaccaatattctactttctgtctctatgaatgtgactaccctggttacctcatataatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggatagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctgtttaatggatcgagaagtggcgttgcttgctgaaatggacaaagtgaaagctgaagcaatggaaattttgctcagccgacagcagcaattggttgagctcagagctgatatcaagcactttgttagtgaacgtaaatatgatgaggatctgggacgagtagcccggttcacctgtgatgtagagaccctaaagaagagcattgattcatttggacaagtgtctcatccaaagaacagctattcgaccagatcccgatgtagctcagttacatctgtgtccttgagtagcccaagtgatgcctctgctgcttcctcttccacctgtgcctctcctcccagccttacaagtgctaacaagaaaaactttgcaccgggagagactcctgcagccatagcaaactccagtggccagccctaccagccacttcgggaggtattgccagggaacagacgaggaggacagggctataggccacaaggccaaaagtccaatgaccccatgaaccaagggcggcatgacagtatgggtcgttacagaaacagctcgtggtattcatctggttccaggtatcagagtgctccatctcaggcaccaggaaacaccattgaaagaggccagactcactctgcagggaccaatggaactggagtcagcatggagcccagccctcccacgccttcattcaaaaaggggctcccccagcgcaaacccaggacctctcagactgaagccgtgaactcttgagagaaaatccagttggcctctctcctctatccacacaattcaacttgataactggactttaggaaacttacagttagatgtaataacaaaaagaagtttatgcgtatcactttttgtgccattctaagtatttttggtttcttgtctccttatttcctctttaccatttttggaggggaagctattttttttccttgatctttcccagtgatatggattgaatctggttggtcatttccaccaggaatcagaggcagctgttaccaggtttcggccttccagttgatccctccactgtccaggctgtctcaggaggaggtgaatcagagctagtctgtcacctttccaatctaagccgaagccacaggtgcctgacaggttcccttctaacaactatttgaccaagagaggcaatcagggggttgtatactgcactggattcgccagagaagggaaaatttaattagtgaaaaggaaagaacactaggaaacatttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtgaaaccctgtctgtactaaaaatacaaaagttagctgagcatggtggcgtgtgcctgtaatctcagctactcaggaggctgaggcaggagaatcgcttgaacccaggaggcggaggctgcagtgagctgagattgtgccactgcactccagcctgggagacagagcaagactcagtctcaaaaaaaaaaaaaaaaagcatttttctgttttaatgtttggagacttttttttttgttctctccctttcctgaaccctattctgatcctgaaccaaatttatagcaatataattagtgttaatctaaggcattactcatcaaaaaaattgctgcagtctttacagttgaataaataaaaacaactgcataaatatgcccacaaaaatttca

SEQ ID NO: 299109 - DNA, 3408 bp, Homo sapiens
atctgctggatctccggcagcatcctgcagtccggcccaggagagaagtggggaggcggcggtgggggcggggcggcgtccggctctgagagagctgggggaggagcgcggcggcgacggcggcggtggctctagaaggggaggtggaggatctcctttcctcttctcagacccgggagcgtccgggacgcggagcccggagctggggcgacgaggcgattgcgggggcctgggctagctgctggctaccaatattctactttctgtctctatgaatgtgactaccctggttacctcatataatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggatagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctggtattccaatgctgctagagttcttggagcaaaatattgccaagtttaatggatcgagaagtggcgttgcttgctgaaatggacaaagtgaaagctgaagcaatggaaattttgctcagccgacaaaagaaggctgaacttctaaagaagatgactcatgtggctgttcaaatgtcagagcagcaattggttgagctcagagctgatatcaagcactttgttagtgaacgtaaatatgatgaggatctgggacgagtagcccggttcacctgtgatgtagagaccctaaagaagagcattgattcatttggacaagtgtctcatccaaagaacagctattcgaccagatcccgatgtagctcagttacatctgtgtccttgagtagcccaagtgatgcctctgctgcttcctcttccacctgtgcctctcctcccagccttacaagtgctaacaagaaaaactttgcaccgggagagactcctgcagccatagcaaactccagtggccagccctaccagccacttcgggaggtattgccagggaacagacgaggaggacagggctataggccacaaggccaaaagtccaatgaccccatgaaccaagggcggcatgacagtatgggtcgttacagaaacagctcgtggtattcatctggttccaggtatcagagtgctccatctcaggcaccaggaaacaccattgaaagaggccagactcactctgcagggaccaatggaactggagtcagcatggagcccagccctcccacgccttcattcaaaaaggggctcccccagcgcaaacccaggacctctcagactgaagccgtgaactcttgagagaaaatccagttggcctctctcctctatccacacaattcaacttgataactggactttaggaaacttacagttagatgtaataacaaaaagaagtttatgcgtatcactttttgtgccattctaagtatttttggtttcttgtctccttatttcctctttaccatttttggaggggaagctattttttttccttgatctttcccagtgatatggattgaatctggttggtcatttccaccaggaatcagaggcagctgttaccaggtttcggccttccagttgatccctccactgtccaggctgtctcaggaggaggtgaatcagagctagtctgtcacctttccaatctaagccgaagccacaggtgcctgacaggttcccttctaacaactatttgaccaagagaggcaatcagggggttgtatactgcactggattcgccagagaagggaaaatttaattagtgaaaaggaaagaacactaggaaacatttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtgaaaccctgtctgtactaaaaatacaaaagttagctgagcatggtggcgtgtgcctgtaatctcagctactcaggaggctgaggcaggagaatcgcttgaacccaggaggcggaggctgcagtgagctgagattgtgccactgcactccagcctgggagacagagcaagactcagtctcaaaaaaaaaaaaaaaaagcatttttctgttttaatgtttggagacttttttttttgttctctccctttcctgaaccctattctgatcctgaaccaaatttatagcaatataattagtgttaatctaaggcattactcatcaaaaaaattgctgcagtctttacagttgaataaataaaaacaactgcataaatatgcccacaaaaatttca

SEQ ID NO: 299110 - DNA, 3230 bp, Homo sapiens
atctgctggatctccggcagcatcctgcagtccggcccaggagagaagtggggaggcggcggtgggggcggggcggcgtccggctctgagagagctgggggaggagcgcggcggcgacggcggcggtggctctagaaggggaggtggaggatctcctttcctcttctcagacccgggagcgtccgggacgcggagcccggagctggggcgacgaggcgattgcgggggcctgggctagctgctggctaccaatattctactttctgtctctatgaatgtgactaccctggttacctcatataatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggatagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctgtttaatggatcgagaagtggcgttgcttgctgaaatggacaaagtgaaagctgaagcaatggaaattttgctcagccgacaaaagaaggctgaacttctaaagaagatgactcatgtggctgttcaaatgtcagagcagcaattggttgagctcagagctgatatcaagcactttgttagtgaacgtaaatatgatgaggatctgggacgagtagcccggttcacctgtgatgtagagaccctaaagaagagcattgattcatttggacaagtgtctcatccaaagaacagctattcgaccagatcccgatgtagctcagttacatctgtgtccttgagtagcccaagtgatgcctctgctgcttcctcttccacctgtgcctctcctcccagccttacaagtgctaacaagaaaaactttgcaccgggagagactcctgcagccatagcaaactccagtggccagccctaccagccacttcgggaggtatcagagtgctccatctcaggcaccaggaaacaccattgaaagaggccagactcactctgcagggaccaatggaactggagtcagcatggagcccagccctcccacgccttcattcaaaaaggggctcccccagcgcaaacccaggacctctcagactgaagccgtgaactcttgagagaaaatccagttggcctctctcctctatccacacaattcaacttgataactggactttaggaaacttacagttagatgtaataacaaaaagaagtttatgcgtatcactttttgtgccattctaagtatttttggtttcttgtctccttatttcctctttaccatttttggaggggaagctattttttttccttgatctttcccagtgatatggattgaatctggttggtcatttccaccaggaatcagaggcagctgttaccaggtttcggccttccagttgatccctccactgtccaggctgtctcaggaggaggtgaatcagagctagtctgtcacctttccaatctaagccgaagccacaggtgcctgacaggttcccttctaacaactatttgaccaagagaggcaatcagggggttgtatactgcactggattcgccagagaagggaaaatttaattagtgaaaaggaaagaacactaggaaacatttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtgaaaccctgtctgtactaaaaatacaaaagttagctgagcatggtggcgtgtgcctgtaatctcagctactcaggaggctgaggcaggagaatcgcttgaacccaggaggcggaggctgcagtgagctgagattgtgccactgcactccagcctgggagacagagcaagactcagtctcaaaaaaaaaaaaaaaaagcatttttctgttttaatgtttggagacttttttttttgttctctccctttcctgaaccctattctgatcctgaaccaaatttatagcaatataattagtgttaatctaaggcattactcatcaaaaaaattgctgcagtctttacagttgaataaataaaaacaactgcataaatatgcccacaaaaatttca

SEQ ID NO: 299111 - DNA, 2381 bp, Homo sapiens
aaaaaaaaaaaaaaaagtatgtgagtacatacatggttaagtaagtaatttccacacggacttttgctttagcacagcttactaaaaaatgtgttttgtagcttgctactgccatctgctggttctcaactcttagacgtctacaattggtgtactgctgcaatgtaccaatattgcaatataaaagggaattgggtctatttattttatttatgggaaaatcttaaaatattctttgttgagagtaagacatcagaatttgtatgtgatccatacaatattattttttagtatgcttttagcaaacaaactcactggtctttctttactattaataatgtgctaattttgtatttgagtttctgatcaaactttttattcctttgtcatcttttcctagtttaatggatcgagaagtggcgttgcttgctgaaatggacaaagtgaaagctgaagcaatggaaattttgctcagccgacaaaagaaggctgaacttctaaagaagatgactcatgtggctgttcaaatgtcagagcagcaattggttgagctcagagctgatatcaagcactttgttagtgaacgtaaatatgatgaggatctgggacgagtagcccggttcacctgtgatgtagagaccctaaagaagagcattgattcatttggacaagtgtctcatccaaagaacagctattcgaccagatcccgatgtagctcagttacatctgtgtccttgagtagcccaagtgatgcctctgctgcttcctcttccacctgtgcctctcctcccagccttacaagtgctaacaagaaaaactttgcaccgggagagactcctgcagccatagcaaactccagtggccagccctaccagccacttcgggaggtattgccagggaacagacgaggaggacagggctataggccacaaggccaaaagtccaatgaccccatgaaccaagggcggcatgacagtatgggtcgttacagaaacagctcgtggtattcatctggttccaggtatcagagtgctccatctcaggcaccaggaaacaccattgaaagaggccagactcactctgcagggaccaatggaactggagtcagcatggagcccagccctcccacgccttcattcaaaaaggggctcccccagcgcaaacccaggacctctcagactgaagccgtgaactcttgagagaaaatccagttggcctctctcctctatccacacaattcaacttgataactggactttaggaaacttacagttagatgtaataacaaaaagaagtttatgcgtatcactttttgtgccattctaagtatttttggtttcttgtctccttatttcctctttaccatttttggaggggaagctattttttttccttgatctttcccagtgatatggattgaatctggttggtcatttccaccaggaatcagaggcagctgttaccaggtttcggccttccagttgatccctccactgtccaggctgtctcaggaggaggtgaatcagagctagtctgtcacctttccaatctaagccgaagccacaggtgcctgacaggttcccttctaacaactatttgaccaagagaggcaatcagggggttgtatactgcactggattcgccagagaagggaaaatttaattagtgaaaaggaaagaacactaggaaacatttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtgaaaccctgtctgtactaaaaatacaaaagttagctgagcatggtggcgtgtgcctgtaatctcagctactcaggaggctgaggcaggagaatcgcttgaacccaggaggcggaggctgcagtgagctgagattgtgccactgcactccagcctgggagacagagcaagactcagtctcaaaaaaaaaaaaaaaaagcatttttctgttttaatgtttggagacttttttttttgttctctccctttcctgaaccctattctgatcctgaaccaaatttatagcaatataattagtgttaatctaaggcattactcatcaaaaaaattgctgcagtctttacagttgaataaataaaaacaactgcataaatatgcccacaaaaatttca

SEQ ID NO: 299112 - DNA, 2271 bp, Homo sapiens
aaaaaaaaaaaaaaaagtatgtgagtacatacatggttaagtaagtaatttccacacggacttttgctttagcacagcttactaaaaaatgtgttttgtagcttgctactgccatctgctggttctcaactcttagacgtctacaattggtgtactgctgcaatgtaccaatattgcaatataaaagggaattgggtctatttattttatttatgggaaaatcttaaaatattctttgttgagagtaagacatcagaatttgtatgtgatccatacaatattattttttagtatgcttttagcaaacaaactcactggtctttctttactattaataatgtgctaattttgtatttgagtttctgatcaaactttttattcctttgtcatcttttcctagtttaatggatcgagaagtggcgttgcttgctgaaatggacaaagtgaaagctgaagcaacactttgttagtgaacgtaaatatgatgaggatctgggacgagtagcccggttcacctgtgatgtagagaccctaaagaagagcattgattcatttggacaagtgtctcatccaaagaacagctattcgaccagatcccgatgtagctcagttacatctgtgtccttgagtagcccaagtgatgcctctgctgcttcctcttccacctgtgcctctcctcccagccttacaagtgctaacaagaaaaactttgcaccgggagagactcctgcagccatagcaaactccagtggccagccctaccagccacttcgggaggtattgccagggaacagacgaggaggacagggctataggccacaaggccaaaagtccaatgaccccatgaaccaagggcggcatgacagtatgggtcgttacagaaacagctcgtggtattcatctggttccaggtatcagagtgctccatctcaggcaccaggaaacaccattgaaagaggccagactcactctgcagggaccaatggaactggagtcagcatggagcccagccctcccacgccttcattcaaaaaggggctcccccagcgcaaacccaggacctctcagactgaagccgtgaactcttgagagaaaatccagttggcctctctcctctatccacacaattcaacttgataactggactttaggaaacttacagttagatgtaataacaaaaagaagtttatgcgtatcactttttgtgccattctaagtatttttggtttcttgtctccttatttcctctttaccatttttggaggggaagctattttttttccttgatctttcccagtgatatggattgaatctggttggtcatttccaccaggaatcagaggcagctgttaccaggtttcggccttccagttgatccctccactgtccaggctgtctcaggaggaggtgaatcagagctagtctgtcacctttccaatctaagccgaagccacaggtgcctgacaggttcccttctaacaactatttgaccaagagaggcaatcagggggttgtatactgcactggattcgccagagaagggaaaatttaattagtgaaaaggaaagaacactaggaaacatttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtgaaaccctgtctgtactaaaaatacaaaagttagctgagcatggtggcgtgtgcctgtaatctcagctactcaggaggctgaggcaggagaatcgcttgaacccaggaggcggaggctgcagtgagctgagattgtgccactgcactccagcctgggagacagagcaagactcagtctcaaaaaaaaaaaaaaaaagcatttttctgttttaatgtttggagacttttttttttgttctctccctttcctgaaccctattctgatcctgaaccaaatttatagcaatataattagtgttaatctaaggcattactcatcaaaaaaattgctgcagtctttacagttgaataaataaaaacaactgcataaatatgcccacaaaaatttca

SEQ ID NO: 299113 - DNA, 1442 bp, Homo sapiens
  misc_feature (1391)..(1391): n is a, c, g, or t
  misc_feature (1414)..(1414): n is a, c, g, or t
atctgctggatctccggcagcatcctgcagtccggcccaggagagaagtggggaggcggcggtgggggcggggcggcgtccggctctgagagagctgggggaggagcgcggcggcgacggcggcggtggctctagaaggggaggtggaggatctcctttcctcttctcagacccgggagcgtccgggacgcggagcccggagctggggcgacgaggcgattgcgggggcctgggctagctgctggctaccaatattctactttctgtctctatgaatgtgactaccctggttacctcatataatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggatagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctgtgattganactgttatggtcagaatggcgtnttctgatggcaagtgaactgaacatgga

SEQ ID NO: 299114 - DNA, 1521 bp, Homo sapiens
atctgctggatctccggcagcatcctgcagtccggcccaggagagaagtggggaggcggcggtgggggcggggcggcgtccggctctgagagagctgggggaggagcgcggcggcgacggcggcggtggctctagaaggggaggtggaggatctcctttcctcttctcagacccgggagcgtccgggacgcggagcccggagctggggcgacgaggcgattgcgggggcctgggctagctgctggctaccaatattctactttctgtctctatgaatgtgactaccctggttacctcatataatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggatagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctgtgtttaatggatccaggaagtggccgttgctttgcttgaaatggcccaaaagtggaaagcttgaaacccaatggaaaattttggttcaaccccgccaaaaggaaggcttgaactttcttaaaggaagaaggaccttca

SEQ ID NO: 299115 - DNA, 1761 bp, Homo sapiens
atctgctggatctccggcagcatcctgcagtccggcccaggagagaagtggggaggcggcggtgggggcggggcggcgtccggctctgagagagctgggggaggagcgcggcggcgacggcggcggtggctctagaaggggaggtggaggatctcctttcctcttctcagacccgggagcgtccgggacgcggagcccggagctggggcgacgaggcgattgcgggggcctgggctagctgctggctaccaatattctactttctgtctctatgaatgtgactaccctggttacctcatataatctccctggaaaaggagacatgaatgtctgcaatgatacttcctgacaagaagttgatacaagaaaaggaaaggagattaacagctagtgagcagaatttcgaacagcaggatttcgtattttttgcttccaactgcacacttccgttgcccacttttaaatcagagatacctacactcaaaacccagacaaggcaaaaggatacttttcttgtatattttttgagatcgaagaaacgacaatgtccaggaaacagaaccagaaggattcatcaggattcatttttgatttgcagtccaataccgtactggcccagggaggagcttttgagaacatgaaagagaagataaatgcggtacgtgcaatagttcctaataagagcaacaatgaaattatcctggttttgcagcactttgataactgtgtggacaaaacagtacaagcattcatggaaggtagtgccagtgaagtactcaaagaatggacagtaacaggcaagaaaaagaacaaaaagaagaaaaacaaaccgaaacctgccgcagaaccaagtaacggcatcccagattccagtaaatcagtttccattcaagaggaacagtctgcgccttcctcagagaaaggtggtatgaatggctaccatgtcaatggtgccatcaatgacactgagtctgtggactcactcagtgaaggtttggagacactttcaatagatgccagagaattggaggatcccgagtctgccatgctagatacgctggatagaacaggatccatgctgcagaatggtgtctctgattttgagaccaagtctttgactatgcactctattcacaattctcaacaacccaggaatgctgccaaatctctctcaagacctaccacagaaactcagttttcaaatatggggatggaagatgttcccctcgccaccagtaaaaagctaagttccaatattgaaaaatctgtaaaagacctccagcgctgcacagtgtctcttgcacggtatcgagttgtagttaaagaagagatggatgcctccattaagaaaatgaaacaagcctttgctgaattggagagctggtattccaatgctgctagagttcttggagcaaaatattgccaaggtttgggaaatgctttcttagcaaagtattgctaccccacaataattgtatcttctctccagtttgatgcttttggattaatatgtcaaccaaatttgtttagttacaagtctgtttattaacatcatgcgtaacgattatcaaacctatgttctctggcacttccctataaaagatttgctccttgaggaaatgaccctgccttagacatttttgtatgtctcacactatagtctccacattaactactttgtgctaacataactatgtattgagctaaattgaattagagcgagagagaaagagtgtgtgtgtgtgtgtgtgtgtgtgtgtg

SEQ ID NO: 299116 - DNA, 706 bp, Homo sapiens
gttgtgcttttgttttgtcttttaggtattccaatgctgctagagttcttggagcaaaatattgccaaggtttgggaaatgctttcttagcaaagtattgctaccccacaataattgtatcttctctccagtttgatgcttttggattaatatgtcaaccaaatttgtttagttacaagtctgtttattaacatcatgcgtaacgattatcaaacctatgttctctggcacttccctataaaagatttgctccttgaggaaatgaccctgccttagacatttttgtatgtctcacactatagtctccacattaactactttgtgctaacataactatgtattgagctaaattgaattagagcgagagagaaagagtgtgtgtgtgtgtgtgtgtgtgtgtgtgagtgtgattacaaccagaaacaagagtggaacttttatttaccctgtagttatattccccttcaaaaggagaaatcagaatgaactccaaatttgaagaaagttggaacattgcatgtttgtgcaagtattaacattctagatttttttttctttttgccaccacaaagcaaaaccgatatggtaaggaaaattattttcatccagaggttgaatactagggtactactgtctccttatacattgaaggctgtgggctcttttataacaacatggaaaagctttatgtgcctataaaccattt

SEQ ID NO: 299117 - DNA, 2064 bp, Homo sapiens
ttcggccggttctcccgggaagctattaatagcattacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaa

SEQ ID NO: 299118 - DNA, 2209 bp, Homo sapiens
ttcggccggttctcccgggaagctattaatagcattacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaacttcagtattagcagagccacaggccgcctctgtggcatcaccagggtttctctgaagaagagggtctgcattttcctaaacccagtgctgctctcccatctcccatcttcctctcgcagcttgatgagccccggtgtgtcccaggagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaa

SEQ ID NO: 299119 - DNA, 1010 bp, Homo sapiens
  misc_feature (955)..(955): n is a, c, g, or t
  misc_feature (984)..(984): n is a, c, g, or t
  misc_feature (990)..(990): n is a, c, g, or t
ttcggccggttctcccgggaagctattaatagcattacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaaagtgagtgccttctagccttacccttcctctcgctcacgcctgtcttcaccagcttcatgtggctatcagaagaagagttagaaaaccccctacttggttatagtttcccaagaagggccttgtagctggtagcagaaatgccagttgcagaatgaggaggtggcaaagcagttaacacaatggatgtgacggtggatgtataaaaacaggtgtgtgaattcgtctgatgcctgactcccagcagcctcggccggttcatacatgtccatcagcttccaggctgcaggacatgccagcccagttaaagnttcattgatgttctaaaaagactgcactntattgntacttgaagcttaatacttt

SEQ ID NO: 299120 - DNA, 859 bp, Homo sapiens
ttcggccggttctcccgggaagctattaatagcattacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggaggtgagcgctggaagccgagggagtgagcgcgacgagggctgctcgccttcattcccttcgcgcccctctaagtaaccagtccgccgacccctgacccaccccggatccgcgcccccagcctccggcttggaaataactctggcttaaacttcttctaagccaccgctgctcctcggcgcttcgaaaagtttcccgcaaagcgaaagaactaactttctcttttgacttggggcgcgaaaggttcctggtgacggaggtcgggcgtccactctgccgccagcctcgagcgccgcttctctccgccgacggcgctggcttgcccggctgggagagggcgtaaggtgggtgggcgggtgcgttggggtgtccgaggctgcctcgctcgccgtcccgctccatccctcgcttcgagacacggcactgtgggagccgatccttcccgggtggggtgggggggggcgcagagaggcacgaaggccggaggcttgcgggagggctgccccacgcgccgagaggaatgaatggggaaggggcgagagggcgggaggcgtcccgggcgcggccg

SEQ ID NO: 299121 - DNA, 3187 bp, Homo sapiens
ttcggccggttctcccgggaagctattaatagcattacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaaagtgagtgccttctagccttacccttcctctcgctcacgcctgtcttcaccagcttcatgtggctatcagaagaagagttagaaaaccccctacttggttatagtttcccaagaagggccttgtagctggtagcagaaatgccagttgcagaatgaggaggtggcaaagcagttaacacaatggatgtgacggtggatgtataaaaacaggtgtgtgaattcgtctgatgcctgactcccagcagcctcggccggttcatacatgtccatcagcttccaggctgcaggacatgccagcccagttaaagaggcttcacttgactgttttcctgagaaaaggaagctgccagctctcatttggctcactatgaaaagcctttaattaatctcttcaaacaagttatttccttaatccacaagcagtggttacacttgctttgcattcttgtctggttcctaactctagagcccttctccctggcttagccagtaagctgagcccctggctgcgttcagccggcccgcctgagagacactaggggaaatagcttttgtgggcaagcagggtggccggtggtgctcagcagtctttccagtggctgtgtccctcctccaaatgtggacaggccatgacagagtcttagcccaagtcccacagatccccaaaagttctgttgattgcttcaggggatcagtgaaaattagggaattttgtgtgttgctatatacattttttctggggagatgagcttctcattgagatctgtgactcagaatcgactaagccaccataagtctggatttctccccagctcccaaggcccttttgggtccagaagacctgcatatgggctgtgactcatgcaaatgaggtatctgaactgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtgtcccaggtacacccctgcatccaggcagcagcccaggccaccccctcctcactggcccttggctcctttcttgatgcctctgttgcttgtcccccaggagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaa

SEQ ID NO: 299122 - DNA, 3141 bp, Homo sapiens
tgatgctccaggtgaagtcagaggtgaatggggttgcccttgggtcttgaattgaagaagaggccgggagtgggtggctaggtaatgatcctgagatcattcctggttctcaaagaaaggagatgtttaccagacagaatctgtttcggctttaaatgattatagttaataccaatagttatcaatttgcatattatcctcatctcaaaatccaaatgcatttttaaaattggctaacttttaatttactaatatattgccggtataattttaactttgatttttgttgttcactcacgtgtgtgtgtgtgcgtgtgtgtgtgtgtgtgtgtaggggttttcacacaaaagtctagagctttagtatttcggggtcttttagcgctagcattgcccttgtctgccagcttttgctggcagtaaaaggcagtgtatttgaggtaggtggcatttcttactgccctttaaatgtgtttcttttggattttacaggtagcccctgaagaagatgaaaggaaaaagaggcgacgagaaagaaataagattgcagctgcaaagtgccgaaacaagaagaaggagaagacggagtgcctgcagaaaagtgagtgccttctagccttacccttcctctcgctcacgcctgtcttcaccagcttcatgtggctatcagaagaagagttagaaaaccccctacttggttatagtttcccaagaagggccttgtagctggtagcagaaatgccagttgcagaatgaggaggtggcaaagcagttaacacaatggatgtgacggtggatgtataaaaacaggtgtgtgaattcgtctgatgcctgactcccagcagcctcggccggttcatacatgtccatcagcttccaggctgcaggacatgccagcccagttaaagaggcttcacttgactgttttcctgagaaaaggaagctgccagctctcatttggctcactatgaaaagcctttaattaatctcttcaaacaagttatttccttaatccacaagcagtggttacacttgctttgcattcttgtctggttcctaactctagagcccttctccctggcttagccagtaagctgagcccctggctgcgttcagccggcccgcctgagagacactaggggaaatagcttttgtgggcaagcagggtggccggtggtgctcagcagtctttccagtggctgtgtccctcctccaaatgtggacaggccatgacagagtcttagcccaagtcccacagatccccaaaagttctgttgattgcttcaggggatcagtgaaaattagggaattttgtgtgttgctatatacattttttctggggagatgagcttctcattgagatctgtgactcagaatcgactaagccaccataagtctggatttctccccagctcccaaggcccttttgggtccagaagacctgcatatgggctgtgactcatgcaaatgaggtatctgaactgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtgtcccaggtacacccctgcatccaggcagcagcccaggccaccccctcctcactggcccttggctcctttcttgatgcctctgttgcttgtcccccaggagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaa

SEQ ID NO: 299123 - DNA, 3104 bp, Homo sapiens
ttttgttcatgtcactgagctatgtgtattttaagaacctgctttacttaagatgaggatggcatgaaatgaaaacaaaacagaaacccaagggcttatgggacttttctctgagggtggggctctggtgttggaggtctggtgggggagggggacttgatcccatgccccagagcccctgaaacagtttgggtttcaatgtgtctttcagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaaagtgagtgccttctagccttacccttcctctcgctcacgcctgtcttcaccagcttcatgtggctatcagaagaagagttagaaaaccccctacttggttatagtttcccaagaagggccttgtagctggtagcagaaatgccagttgcagaatgaggaggtggcaaagcagttaacacaatggatgtgacggtggatgtataaaaacaggtgtgtgaattcgtctgatgcctgactcccagcagcctcggccggttcatacatgtccatcagcttccaggctgcaggacatgccagcccagttaaagaggcttcacttgactgttttcctgagaaaaggaagctgccagctctcatttggctcactatgaaaagcctttaattaatctcttcaaacaagttatttccttaatccacaagcagtggttacacttgctttgcattcttgtctggttcctaactctagagcccttctccctggcttagccagtaagctgagcccctggctgcgttcagccggcccgcctgagagacactaggggaaatagcttttgtgggcaagcagggtggccggtggtgctcagcagtctttccagtggctgtgtccctcctccaaatgtggacaggccatgacagagtcttagcccaagtcccacagatccccaaaagttctgttgattgcttcaggggatcagtgaaaattagggaattttgtgtgttgctatatacattttttctggggagatgagcttctcattgagatctgtgactcagaatcgactaagccaccataagtctggatttctccccagctcccaaggcccttttgggtccagaagacctgcatatgggctgtgactcatgcaaatgaggtatctgaactgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtgtcccaggtacacccctgcatccaggcagcagcccaggccaccccctcctcactggcccttggctcctttcttgatgcctctgttgcttgtcccccaggagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaa

SEQ ID NO: 299124 - DNA, 1845 bp, Homo sapiens
gacaagaagagaaatcctcctctatataggatgctctgctgtttcctaaggattttcagcaccttgccccaaaatcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaa

SEQ ID NO: 299125 - DNA, 1602 bp, Homo sapiens
ggtgtctaagatcccggtacgctactagtgccagtgctgctctcccatctcccatcttcctctcgcagcttgatgagccccggtgtgtcccaggtacacccctgcatccaggcagcagcccaggccaccccctcctcactggcccttggctcctttcttgatgcctctgttgcttgtcccccaggagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaa

SEQ ID NO: 299126 - DNA, 2041 bp, Homo sapiens
ttcggccggttctcccgggaagctattaatagcattacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaa

SEQ ID NO: 299127 - DNA, 1664 bp, Homo sapiens
taacggctaggtagcgaggcctgggtgttgctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaa

SEQ ID NO: 299128 - DNA, 1477 bp, Homo sapiens
tcggtccgctgatgtgcagatcttgaagaaggagaagacggagtgcctgcagaatgagcgagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaa

SEQ ID NO: 299129 - DNA, 1662 bp, Homo sapiens
ttcggccggttctcccgggaagctattaatagcattacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggattcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaa

SEQ ID NO: 299130 - DNA, 2537 bp, Homo sapiens
ttcggccggttctcccgggaagctattaatagcattacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaaaaaaaaaaaaaagaaagaaaaaagaaaaaaaacaacaaaggggggggcggcaaaaaaatttcccccggggggcccccattgtgggcgcacccccttttttgggcaaaaagggggcccccaatagggggggatttaaaaacaggcggggcggggtaaacaccgggggcgggggacacctgccgggggctcttgggagagagcccacccggggggggcactagggacaccaccccgggaattcacggcctagggaaataaaactaaggcggacaggggaacccagcgaatttctgcgtagaacgtggcacggctagttaagcattcggggggacatgacacgcgaccacacacagtcggaaaacaataagacagagaacaagctatacagctagtaacgaaacatagtgacagaggcggacagacatgacacactacacagtcgagaggcacatgagcagagagatcacaatctc

SEQ ID NO: 299131 - DNA, 2063 bp, Homo sapiens
ttcggccggttctcccgggaagctattaatagcattacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgggccccagggggacccaacttcaaatccgaatcct

SEQ ID NO: 299132 - DNA, 734 bp, Homo sapiens
gtattgtatttttcgtcactacctccccgagcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaa

SEQ ID NO: 299133 - DNA, 1455 bp, Homo sapiens
ttcggccggttctcccgggaagctattaatagcattacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaa

SEQ ID NO: 299134 - DNA, 2010 bp, Homo sapiens
ttcggccggttctcccgggaagctattaatagcattacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattggaaccaagacatggtaaa

SEQ ID NO: 299135 - DNA, 1566 bp, Homo sapiens
  misc_feature (1234)..(1234): n is a, c, g, or t
  misc_feature (1365)..(1365): n is a, c, g, or t
  misc_feature (1431)..(1431): n is a, c, g, or t
  misc_feature (1554)..(1554): n is a, c, g, or t
ttcggccggttctcccgggaagctattaatagcattacgtcagcctgggactggcaacacggagtaaacgaccgcgccgccagcctgagggctataaaaggggtgatgcaacgctctccaagccacagtcgcacgcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatgggcatctctcacgtgtacatngactcgaggatgtgatggacagattatgagtgtcacggcaggtgtctttacaaatgctgatgcgaaatgttcagaactagatgctctcgatgtggaacacatgtgacttaattgcttcaacggtctagagntgggcgctgaccatgcgttcagatcgtgcaaactgacaagagcgattcagtacaatctgcgtagcngtttgacatcagcaggagcagctcaggtgctcatgtgcagtgttgacaatcatttctggacacggggttaaccgggggggcctctttataattttttaaaacgcgggagcctcccgctatatntcgatcgcgcct

SEQ ID NO: 299136 - DNA, 4586 bp, Homo sapiens
aaatagtccagcagaggagtgtgggggaagggggcaggagaggcacaagaataagggagacctggactctgcctttttgggaaaaggaaccaagctcatagcaatttggctgataacacaatcagatttttccaggttaagcttcctttctgttatactttcatcattgtgatgctgtggtagaaagtaaataacagtagtggctcagtcatttaatctttcccctctataatacaacttacttgaaatttaaatcaagaaaaaatttctgacgctgagctaggttggtggcatgatatgccaggggtcagtgggggagcttgcttctgagccccctgttgtccgcctggagtcctgcttgtctttcccagctgtgctgagtggctcttctgtctccctggggtccctggcacatctgctttcccagctctgtgaccttaccagttctctcctcagccggtgacttggttgagctgaatatatgttttaaacttttacataaacaactcaacctgttgcctctcacttccctccatcactgtggcttttaaaactcatgtattttgactcaagtgaaaaaaacacaaaaatccctcatcccagctaggttttgccccctgccctataagagagctatttccccctttctttcctttgaattcttctccaacaccatcccttcattcatactgccctgtgatacacttgaagctgtgttgattggacagacgttcatcagctaacttacctttacttggcaagatggtaaaatagtaacttagtgatgttactaaagtctcgaccattcacctttccatactgaaggaaaggtaaaaaggtttcttctatgggaaattatgcttgacttgcatactctagtttgatgaggataaaaagaaacatgtaattgcagtggtgtttacaaccaagttaccgatcacgggaaccaatcatagatttctttgttccttctccactctcaacacttcatttgactagaaaaaaaaaatgtattcaccaaggaacaggacccaatttgttcagacttttgttaagtttctttactaaggcaatttttgaaacaccagttactatgggatggtgggaatttttcatgcttaagaaatagagacttaggaacaaagaaacatctttctggagaagatgctaatgggaagttacctaaggcttgatgcttggttcaaccttatttaaaatttttataaatgacctgaaagtaggattttacagtgaaatcaaatgtcactacttccaggcagtgaaaggtaatctagaagaggtttaaaaaacacaaaaccggtcgggcacagcggctcacgcctgtaatcccagcactttgggaggccgaggcggggagatcacgagttcaggagatcgagaccatcctggccaacatggtgaaactttgtttccactaaaaatacaaaaattagctgggtgtggtggtgggtgcctgtagttccagctactcgggaggctgaagcaggagaatcgcttgaacccgggaggcagaggttgcagtgagccgagatagcgccattgcactccagcctgtcaacagagtgagactccgtctcacaacaaacaaacaaacacaaaaccacagaagggttactaataagcagggctgagaatactcagaaaactgacaggtgaggttcaacataatataaggaaatgtatttatggaagaattatcaactgatatgcctgaacactgttagaactcaggaaagaaacaagcattgctgagggggaggagagatcaatgtgctgctgtggccaaaagcctaattgccctgtgggcatcatcaggaagggcttttggagataacagagaacagcactttatacaaaaccatggatatgtcttgatcggattatctgtgtttctagtgaccttatttacaagatatatgataaagggaggaaaggtccagagaacagccaaaattatcaggggatggaggtatatccatatgaggacacatttttaaaatatagactctatcctgcaaagatgaaagcagaggggagttagatcaaatatccaatcaagagcaaggacccggtcctgtactactagctctagggctctatctcatagccttagtaaagaaagcacttctcatagcaaatcagaaatgtaaggagctcattgtctaagaagggatgccaccagaaactatacatgggtgcaggtttatgaggaatccttgcatgacggccttctacaaggaattatagaaaagtagggctacttggtaatatacaactgagagggtaactgtgtccctcaacaaactactccttagtgcctctttcaaaggcagaatgttgatctgaatggatcactggtcaagtatggcatctctaatgttcttgaagggggaggaaggagatctggtagctggaaaatataattattccacgttaggctcacctgaattggtttaaaatcatattctgattctcttctcatcccttcctcccctcacccaccatatacctctggcatccctccatgcaaagaaatgtcgaataggcatttcttggtataatttacctacacttgtgcttgtggggtgggagtaaaaacatatccagtaagtaccaaggctaacctcctaatggctggagctcagttaggtctctgggctctctaaaggagtccagagctcttgtccatgtcacaaatggagccttagaatttctgtctttccttatgtggcagctttggccattgtgtcttgaaattctccctcaggaaatgtgataggggatattatcccatgggattttagtaaaaatcagcttgcctaatttcatattcgtgttcataatgaagaaatgcgaagtggtggtagtcctcaggattaagtgtaaaggaaaatatgcaaggaaaaagtagcagtgtcagcccttttggactgcttatgatttctgccttagagctacaagacttggaacaagaaataacaatacctcaagaaaatgtctggagagatagcaccactgtccctcaaagacttcagccactgcacattaccaattcagctgtgaagcatttacaactgtattatctgtgattgtctgcatttcctgtttacatgcatgtgctggggatatgctttagtgtgtatggactagagtttaaatcctgtctttaactgggctgcaaggatggctatcaatcccaaattctgttttcaactcactggaataattaatctggtgttcctgatataaaacaggtgggttctattcacatgatggctgctctttaccatatatttcacctgaccctcattttgccatgggcctcaacctttatgtgtgctttttatggctctgaaaggactggctcccgtgtgtggaatatacaaggtataaacaccacccctcacatacccctgtaacttaaatgcttccatttaactcacttagattactttccccttagtggtaaacgggttgggggatgggtggtagtgcaaagaaggtagtttgaaatattgccatagtaatatgggaactttttattccaaccctttaccctggcttttttttctctcaatatttgcctaaaattctaaaatgagttatagtaaaatcataaaactatggaaacaactgaactttggtacacaagttagttcgatgacatcttgttatttgagaacagtaaaaggtgtgtcattgcctcatgatttatcatagtcattactaagggtttcagagagaatctggtgtgaagcactatcctttcagacactaaggcctttacctagttgctcccctaccttctgtcggaataggattattcccatgcacctctgggtaggtataggtagtagctattgaacggggattattttccccatggcacaaggggaaacactcttggataaccttcaacaatgaggctttgctaagtggccagacttgggatttgatcttcctcacttgttatttattaagtttaagccttattcagtatctctaattgcaatagatatagttcctgtgacttctaaaaaaaattcctgttaatgctgagacagtatcttttttgtcagtttattaatttttggtcaagatttagcctgagtcttaaagcatttatttgtggaatgccccactgaagtgtcttctccattggctaagtacatgtttaaagccatgggttttaatgtaagatactttcagtatctaattctgtttcccccactgagggtgctaaagagaattagaatctttactaagacatgctcaggaaagcttcacgagagaacagcttcaaaatcctccctatgacactgaatggtagtgaggaaagaattcttggggatgccagttacatacaatagccttattactgctaatcactgtcaataaaaggtcacttcattcacctctatttgaggaaaacaatgagaatgtatctgatgaactagaatccttgtcagtattgggaaattttaatgttgcaatatctagtcaaactttgagtgtactggttctgtgaaccacctgaaaaaacaaattaaatgtattaaaccata

SEQ ID NO: 299137 - DNA, 4598 bp, Homo sapiens
gattgagcttctgaactccagcatcaccctaaaggatgatatcccccccatctatccaacatctccaggccccatccccatcactctggccatggaacatgttgtgctgaagaggagtgatgatggtgtgttccacataggcgctgctgctcaggacaaaccatcagctgaagtacttaaaagtgagaagagacagcccccaaaagaacaggtgtttttggtgcccacaggagaggtttttgaacagcaggtgaaagaactgcctatcctacaaaaagaacttatagaaactaaacaagccttggccaatgccaaccaggataaagaaaacttcttcaggagattaggaaatataaccccttctttgagctctgaaaccagtggctcagccatctgtgccaaggagagaggctatcaccagcaatagcaccacctaggacagagggcactgtccagtgctctcctcagccggtgacttggttgagctgaatatatgttttaaacttttacataaacaactcaacctgttgcctctcacttccctccatcactgtggcttttaaaactcatgtattttgactcaagtgaaaaaaacacaaaaatccctcatcccagctaggttttgccccctgccctataagagagctatttccccctttctttcctttgaattcttctccaacaccatcccttcattcatactgccctgtgatacacttgaagctgtgttgattggacagacgttcatcagctaacttacctttacttggcaagatggtaaaatagtaacttagtgatgttactaaagtctcgaccattcacctttccatactgaaggaaaggtaaaaaggtttcttctatgggaaattatgcttgacttgcatactctagtttgatgaggataaaaagaaacatgtaattgcagtggtgtttacaaccaagttaccgatcacgggaaccaatcatagatttctttgttccttctccactctcaacacttcatttgactagaaaaaaaaaatgtattcaccaaggaacaggacccaatttgttcagacttttgttaagtttctttactaaggcaatttttgaaacaccagttactatgggatggtgggaatttttcatgcttaagaaatagagacttaggaacaaagaaacatctttctggagaagatgctaatgggaagttacctaaggcttgatgcttggttcaaccttatttaaaatttttataaatgacctgaaagtaggattttacagtgaaatcaaatgtcactacttccaggcagtgaaaggtaatctagaagaggtttaaaaaacacaaaaccggtcgggcacagcggctcacgcctgtaatcccagcactttgggaggccgaggcggggagatcacgagttcaggagatcgagaccatcctggccaacatggtgaaactttgtttccactaaaaatacaaaaattagctgggtgtggtggtgggtgcctgtagttccagctactcgggaggctgaagcaggagaatcgcttgaacccgggaggcagaggttgcagtgagccgagatagcgccattgcactccagcctgtcaacagagtgagactccgtctcacaacaaacaaacaaacacaaaaccacagaagggttactaataagcagggctgagaatactcagaaaactgacaggtgaggttcaacataatataaggaaatgtatttatggaagaattatcaactgatatgcctgaacactgttagaactcaggaaagaaacaagcattgctgagggggaggagagatcaatgtgctgctgtggccaaaagcctaattgccctgtgggcatcatcaggaagggcttttggagataacagagaacagcactttatacaaaaccatggatatgtcttgatcggattatctgtgtttctagtgaccttatttacaagatatatgataaagggaggaaaggtccagagaacagccaaaattatcaggggatggaggtatatccatatgaggacacatttttaaaatatagactctatcctgcaaagatgaaagcagaggggagttagatcaaatatccaatcaagagcaaggacccggtcctgtactactagctctagggctctatctcatagccttagtaaagaaagcacttctcatagcaaatcagaaatgtaaggagctcattgtctaagaagggatgccaccagaaactatacatgggtgcaggtttatgaggaatccttgcatgacggccttctacaaggaattatagaaaagtagggctacttggtaatatacaactgagagggtaactgtgtccctcaacaaactactccttagtgcctctttcaaaggcagaatgttgatctgaatggatcactggtcaagtatggcatctctaatgttcttgaagggggaggaaggagatctggtagctggaaaatataattattccacgttaggctcacctgaattggtttaaaatcatattctgattctcttctcatcccttcctcccctcacccaccatatacctctggcatccctccatgcaaagaaatgtcgaataggcatttcttggtataatttacctacacttgtgcttgtggggtgggagtaaaaacatatccagtaagtaccaaggctaacctcctaatggctggagctcagttaggtctctgggctctctaaaggagtccagagctcttgtccatgtcacaaatggagccttagaatttctgtctttccttatgtggcagctttggccattgtgtcttgaaattctccctcaggaaatgtgataggggatattatcccatgggattttagtaaaaatcagcttgcctaatttcatattcgtgttcataatgaagaaatgcgaagtggtggtagtcctcaggattaagtgtaaaggaaaatatgcaaggaaaaagtagcagtgtcagcccttttggactgcttatgatttctgccttagagctacaagacttggaacaagaaataacaatacctcaagaaaatgtctggagagatagcaccactgtccctcaaagacttcagccactgcacattaccaattcagctgtgaagcatttacaactgtattatctgtgattgtctgcatttcctgtttacatgcatgtgctggggatatgctttagtgtgtatggactagagtttaaatcctgtctttaactgggctgcaaggatggctatcaatcccaaattctgttttcaactcactggaataattaatctggtgttcctgatataaaacaggtgggttctattcacatgatggctgctctttaccatatatttcacctgaccctcattttgccatgggcctcaacctttatgtgtgctttttatggctctgaaaggactggctcccgtgtgtggaatatacaaggtataaacaccacccctcacatacccctgtaacttaaatgcttccatttaactcacttagattactttccccttagtggtaaacgggttgggggatgggtggtagtgcaaagaaggtagtttgaaatattgccatagtaatatgggaactttttattccaaccctttaccctggcttttttttctctcaatatttgcctaaaattctaaaatgagttatagtaaaatcataaaactatggaaacaactgaactttggtacacaagttagttcgatgacatcttgttatttgagaacagtaaaaggtgtgtcattgcctcatgatttatcatagtcattactaagggtttcagagagaatctggtgtgaagcactatcctttcagacactaaggcctttacctagttgctcccctaccttctgtcggaataggattattcccatgcacctctgggtaggtataggtagtagctattgaacggggattattttccccatggcacaaggggaaacactcttggataaccttcaacaatgaggctttgctaagtggccagacttgggatttgatcttcctcacttgttatttattaagtttaagccttattcagtatctctaattgcaatagatatagttcctgtgacttctaaaaaaaattcctgttaatgctgagacagtatcttttttgtcagtttattaatttttggtcaagatttagcctgagtcttaaagcatttatttgtggaatgccccactgaagtgtcttctccattggctaagtacatgtttaaagccatgggttttaatgtaagatactttcagtatctaattctgtttcccccactgagggtgctaaagagaattagaatctttactaagacatgctcaggaaagcttcacgagagaacagcttcaaaatcctccctatgacactgaatggtagtgaggaaagaattcttggggatgccagttacatacaatagccttattactgctaatcactgtcaataaaaggtcacttcattcacctctatttgaggaaaacaatgagaatgtatctgatgaactagaatccttgtcagtattgggaaattttaatgttgcaatatctagtcaaactttgagtgtactggttctgtgaaccacctgaaaaaacaaattaaatgtattaaaccata

SEQ ID NO: 299138 - DNA, 4663 bp, Homo sapiens
aaatagtccagcagaggagtgtgggggaagggggcaggagaggcacaagaataagggagacctggactctgcctttttgggaaaaggaaccaagctcatagcaatttggctgataacacaatcagatttttccaggttaagcttcctttctgttatactttcatcattgtgatgctgtggtagaaagtaaataacagtagtggctcagtcatttaatctttcccctctataatacaacttacttgaaatttaaatcaagaaaaaatttctgacgctgagctaggttggtggcatgatatgccaggggtcagtgggggagcttgcttctgagccccctgttgtccgcctggagtcctgcttgtctttcccagctgtgctgagtggctcttctgtctccctggggtccctggcacatctgctttcccagctctgtgaccttaccagttctctcctcagccggtgacttggttgagctgaatatatgttttaaacttttacataaacaactcaacctgttgcctctcacttccctccatcactgtggcttttaaaactcatgtattttgactcaagtgaaaaaaacacaaaaatccctcatcccagctaggttttgccccctgccctataagagagctatttccccctttctttcctttgaattcttctccaacaccatcccttcattcatactgccctgtgatacacttgaagctgtgttgattggacagacgttcatcagctaacttacctttacttggcaagatggtaaaatagtaacttagtgatgttactaaagtctcgaccattcacctttccatactgaaggaaaggtaaaaaggtttcttctatgggaaattatgcttgacttgcatactctagtttgatgaggataaaaagaaacatgtaattgcagtggtgtttacaaccaagttaccgatcacgggaaccaatcatagatttctttgttccttctccactctcaacacttcatttgactagaaaaaaaaaatgtattcaccaaggaacaggacccaatttgttcagacttttgttaagtttctttactaaggcaatttttgaaacaccagttactatgggatggtgggaatttttcatgcttaagaaatagagacttaggaacaaagaaacatctttctggagaagatgctaatgggaagttacctaaggcttgatgcttggttcaaccttatttaaaatttttataaatgacctgaaagtaggattttacagtgaaatcaaatgtcactacttccaggcagtgaaaggtaatctagaagaggtttaaaaaacacaaaaccggtcgggcacagcggctcacgcctgtaatcccagcactttgggaggccgaggcggggagatcacgagttcaggagatcgagaccatcctggccaacatggtgaaactttgtttccactaaaaatacaaaaattagctgggtgtggtggtgggtgcctgtagttccagctactcgggaggctgaagcaggagaatcgcttgaacccgggaggcagaggttgcagtgagccgagatagcgccattgcactccagcctgtcaacagagtgagactccgtctcacaacaaacaaacaaacacaaaaccacagaagggttactaataagcagggctgagaatactcagaaaactgacaggtgaggttcaacataatataaggaaatgtatttatggaagaattatcaactgatatgcctgaacactgttagaactcaggaaagaaacaagcattgctgagggggaggagagatcaatgtgctgctgtggccaaaagcctaattgccctgtgggcatcatcaggaagggcttttggagataacagagaacagcactttatacaaaaccatggatatgtcttgatcggattatctgtgtttctagtgaccttatttacaagatatatgataaagggaggaaaggtccagagaacagccaaaattatcaggggatggaggtatatccatatgaggacacatttttaaaatatagactctatcctgcaaagatgaaagcagaggggagttagatcaaatatccaatcaagagcaaggacccggtcctgtactactagctctagggctctatctcatagccttagtaaagaaagcacttctcatagcaaatcagaaatgtaaggagctcattgtctaagaagggatgccaccagaaactatacatgggtgcaggtttatgaggaatccttgcatgacggccttctacaaggaattatagaaaagtagggctacttggtaatatacaactgagagggtaactgtgtccctcaacaaactactccttagtgcctctttcaaaggcagaatgttgatctgaatggatcactggtcaagtatggcatctctaatgttcttgaagggggaggaaggagatctggtagctggaaaatataattattccacgttaggctcacctgaattggtttaaaatcatattctgattctcttctcatcccttcctcccctcacccaccatatacctctggcatccctccatgcaaagaaatgtcgaataggcatttcttggtataatttacctacacttgtgcttgtggggtgggagtaaaaacatatccagtaagtaccaaggctaacctcctaatggctggagctcagttaggtctctgggctctctaaaggagtccagagctcttgtccatgtcacaaatggagccttagaatttctgtctttccttatgtggcagctttggccattgtgtcttgaaattctccctcaggaaatgtgataggggatattatcccatgggattttagtaaaaatcagcttgcctaatttcatattcgtgttcataatgaagaaatgcgaagtggtggtagtcctcaggattaagtgtaaaggaaaatatgcaaggaaaaagtagcagtgtcagcccttttggactgcttatgatttctgccttagagctacaagacttggaacaagaaataacaatacctcaagaaaatgtctggagagatagcaccactgtccctcaaagacttcagccactgcacattaccaattcagctgtgaagcatttacaactgtattatctgtgattgtctgcatttcctgtttacatgcatgtgctggggatatgctttagtgtgtatggactagagtttaaatcctgtctttaactgggctgcaaggatggctatcaatcccaaattctgttttcaactcactggaataattaatctggtgttcctgatataaaacaggtgggttctattcacatgatggctgctctttaccatatatttcacctgaccctcattttgccatgggcctcaacctttatgtgtgctttttatggctctgaaaggactggctcccgtgtgtggaatatacaaggtataaacaccacccctcacatacccctgtaacttaaatgcttccatttaactcacttagattactttccccttagtggtaaacgggttgggggatgggtggtagtgcaaagaaggtagtttgaaatattgccatagtaatatgggaactttttattccaaccctttaccctggcttttttttctctcaatatttgcctaaaattctaaaatgagttatagtaaaatcataaaactatggaaacaactgaactttggtacacaagttagttcgatgacatcttgttatttgagaacagtaaaaggtgtgtcattgcctcatgatttatcatagtcattactaagggtttcagagagaatctggtgtgaagcactatcctttcagacactaaggcctttacctagttgctcccctaccttctgtcggaataggattattcccatgcacctctgggtaggtataggtagtagctattgaacggggattattttccccatggcacaaggggaaacactcttggataaccttcaacaatgaggctttgctaagtggccagacttgggatttgatcttcctcacttgttatttattaagtttaagccttattcagtatctctaattgcaatagatatagttcctgtgacttctaaaaaaaattcctgttaatgctgagacagtatcttttttgtcagtttattaatttttggtcaagatttagcctgagtcttaaagcatttatttgtggaatgccccactgaagtgtcttctccattggctaagtacatgtttaaagccatgggttttaatgtaagatactttcagtatctaattctgtttcccccactgagggtgctaaagagaattagaatctttactaagacatgctcaggaaagcttcacgagagaacagcttcaaaatcctccctatgacactgaatggtagtgaggaaagaattcttggggatgccagttacatacaatagccttattactgctaatcactgtcaataaaaggtcacttcattcacctctatttgaggaaaacaatgagaatgtatctgatgaactagaatccttgtcagtattgggaaattttaatgttgcaatatctagtcaaactttgagtgtactggttctgtgaaccacctgaaaaaacaaattaaatgtattaaaccataatgattgttgtatatccgttgataagaatctgaaatatatgggcttttatattgtttattttcatctcagtcttggg

SEQ ID NO: 299139 - DNA, 3185 bp, Homo sapiens
agcagcatagatattaccggaggttgatactagtataggaacagtcatgtcttctgggtgtggtggtgggtgcctgtagttccagctactcgggaggctgaagcaggagaatcgcttgaacccgggaggcagaggttgcagtgagccgagatagcgccattgcactccagcctgtcaacagagtgagactccgtctcacaacaaacaaacaaacacaaaaccacagaagggttactaataagcagggctgagaatactcagaaaactgacaggtgaggttcaacataatataaggaaatgtatttatggaagaattatcaactgatatgcctgaacactgttagaactcaggaaagaaacaagcattgctgagggggaggagagatcaatgtgctgctgtggccaaaagcctaattgccctgtgggcatcatcaggaagggcttttggagataacagagaacagcactttatacaaaaccatggatatgtcttgatcggattatctgtgtttctagtgaccttatttacaagatatatgataaagggaggaaaggtccagagaacagccaaaattatcaggggatggaggtatatccatatgaggacacatttttaaaatatagactctatcctgcaaagatgaaagcagaggggagttagatcaaatatccaatcaagagcaaggacccggtcctgtactactagctctagggctctatctcatagccttagtaaagaaagcacttctcatagcaaatcagaaatgtaaggagctcattgtctaagaagggatgccaccagaaactatacatgggtgcaggtttatgaggaatccttgcatgacggccttctacaaggaattatagaaaagtagggctacttggtaatatacaactgagagggtaactgtgtccctcaacaaactactccttagtgcctctttcaaaggcagaatgttgatctgaatggatcactggtcaagtatggcatctctaatgttcttgaagggggaggaaggagatctggtagctggaaaatataattattccacgttaggctcacctgaattggtttaaaatcatattctgattctcttctcatcccttcctcccctcacccaccatatacctctggcatccctccatgcaaagaaatgtcgaataggcatttcttggtataatttacctacacttgtgcttgtggggtgggagtaaaaacatatccagtaagtaccaaggctaacctcctaatggctggagctcagttaggtctctgggctctctaaaggagtccagagctcttgtccatgtcacaaatggagccttagaatttctgtctttccttatgtggcagctttggccattgtgtcttgaaattctccctcaggaaatgtgataggggatattatcccatgggattttagtaaaaatcagcttgcctaatttcatattcgtgttcataatgaagaaatgcgaagtggtggtagtcctcaggattaagtgtaaaggaaaatatgcaaggaaaaagtagcagtgtcagcccttttggactgcttatgatttctgccttagagctacaagacttggaacaagaaataacaatacctcaagaaaatgtctggagagatagcaccactgtccctcaaagacttcagccactgcacattaccaattcagctgtgaagcatttacaactgtattatctgtgattgtctgcatttcctgtttacatgcatgtgctggggatatgctttagtgtgtatggactagagtttaaatcctgtctttaactgggctgcaaggatggctatcaatcccaaattctgttttcaactcactggaataattaatctggtgttcctgatataaaacaggtgggttctattcacatgatggctgctctttaccatatatttcacctgaccctcattttgccatgggcctcaacctttatgtgtgctttttatggctctgaaaggactggctcccgtgtgtggaatatacaaggtataaacaccacccctcacatacccctgtaacttaaatgcttccatttaactcacttagattactttccccttagtggtaaacgggttgggggatgggtggtagtgcaaagaaggtagtttgaaatattgccatagtaatatgggaactttttattccaaccctttaccctggcttttttttctctcaatatttgcctaaaattctaaaatgagttatagtaaaatcataaaactatggaaacaactgaactttggtacacaagttagttcgatgacatcttgttatttgagaacagtaaaaggtgtgtcattgcctcatgatttatcatagtcattactaagggtttcagagagaatctggtgtgaagcactatcctttcagacactaaggcctttacctagttgctcccctaccttctgtcggaataggattattcccatgcacctctgggtaggtataggtagtagctattgaacggggattattttccccatggcacaaggggaaacactcttggataaccttcaacaatgaggctttgctaagtggccagacttgggatttgatcttcctcacttgttatttattaagtttaagccttattcagtatctctaattgcaatagatatagttcctgtgacttctaaaaaaaattcctgttaatgctgagacagtatcttttttgtcagtttattaatttttggtcaagatttagcctgagtcttaaagcatttatttgtggaatgccccactgaagtgtcttctccattggctaagtacatgtttaaagccatgggttttaatgtaagatactttcagtatctaattctgtttcccccactgagggtgctaaagagaattagaatctttactaagacatgctcaggaaagcttcacgagagaacagcttcaaaatcctccctatgacactgaatggtagtgaggaaagaattcttggggatgccagttacatacaatagccttattactgctaatcactgtcaataaaaggtcacttcattcacctctatttgaggaaaacaatgagaatgtatctgatgaactagaatccttgtcagtattgggaaattttaatgttgcaatatctagtcaaactttgagtgtactggttctgtgaaccacctgaaaaaacaaattaaatgtattaaaccata

SEQ ID NO: 299140 - DNA, 2059 bp, Homo sapiens
tatcgtaaagcagaagctactcaactgtgattaggagggaagcccttttgaaatcagtgatttgaaaagataaggcaggtaatacataaaaacatatccagtaagtaccaaggctaacctcctaatggctggagctcagttaggtctctgggctctctaaaggagtccagagctcttgtccatgtcacaaatggagccttagaatttctgtctttccttatgtggcagctttggccattgtgtcttgaaattctccctcaggaaatgtgataggggatattatcccatgggattttagtaaaaatcagcttgcctaatttcatattcgtgttcataatgaagaaatgcgaagtggtggtagtcctcaggattaagtgtaaaggaaaatatgcaaggaaaaagtagcagtgtcagcccttttggactgcttatgatttctgccttagagctacaagacttggaacaagaaataacaatacctcaagaaaatgtctggagagatagcaccactgtccctcaaagacttcagccactgcacattaccaattcagctgtgaagcatttacaactgtattatctgtgattgtctgcatttcctgtttacatgcatgtgctggggatatgctttagtgtgtatggactagagtttaaatcctgtctttaactgggctgcaaggatggctatcaatcccaaattctgttttcaactcactggaataattaatctggtgttcctgatataaaacaggtgggttctattcacatgatggctgctctttaccatatatttcacctgaccctcattttgccatgggcctcaacctttatgtgtgctttttatggctctgaaaggactggctcccgtgtgtggaatatacaaggtataaacaccacccctcacatacccctgtaacttaaatgcttccatttaactcacttagattactttccccttagtggtaaacgggttgggggatgggtggtagtgcaaagaaggtagtttgaaatattgccatagtaatatgggaactttttattccaaccctttaccctggcttttttttctctcaatatttgcctaaaattctaaaatgagttatagtaaaatcataaaactatggaaacaactgaactttggtacacaagttagttcgatgacatcttgttatttgagaacagtaaaaggtgtgtcattgcctcatgatttatcatagtcattactaagggtttcagagagaatctggtgtgaagcactatcctttcagacactaaggcctttacctagttgctcccctaccttctgtcggaataggattattcccatgcacctctgggtaggtataggtagtagctattgaacggggattattttccccatggcacaaggggaaacactcttggataaccttcaacaatgaggctttgctaagtggccagacttgggatttgatcttcctcacttgttatttattaagtttaagccttattcagtatctctaattgcaatagatatagttcctgtgacttctaaaaaaaattcctgttaatgctgagacagtatcttttttgtcagtttattaatttttggtcaagatttagcctgagtcttaaagcatttatttgtggaatgccccactgaagtgtcttctccattggctaagtacatgtttaaagccatgggttttaatgtaagatactttcagtatctaattctgtttcccccactgagggtgctaaagagaattagaatctttactaagacatgctcaggaaagcttcacgagagaacagcttcaaaatcctccctatgacactgaatggtagtgaggaaagaattcttggggatgccagttacatacaatagccttattactgctaatcactgtcaataaaaggtcacttcattcacctctatttgaggaaaacaatgagaatgtatctgatgaactagaatccttgtcagtattgggaaattttaatgttgcaatatctagtcaaactttgagtgtactggttctgtgaaccacctgaaaaaacaaattaaatgtattaaaccata

SEQ ID NO: 299141 - DNA, 651 bp, Homo sapiens
gattgagcttctgaactccagcatcaccctaaaggatgatatcccccccatctatccaacatctccaggccccatccccatcactctggccatggaacatgttgtgctgaagaggagtgatgatggtgtgttccacataggcgctgctgctcaggacaaaccatcagctgaagtacttaaaagtgagaagagacagcccccaaaagaacaggtgtttttggtgcccacaggagaggtttttgaacagcaggtgaaagaactgcctatcctacaaaaagaacttatagaaactaaacaagccttggccaatgccaaccaggataaagaaaacttcttcaggagattaggaaatataaccccttctttgagctctgaaaccagtggctcagccatctgtgccaaggagagaggctatcaccagcaatagcaccacctaggacagagggcactgtccagtgctgaataagtcactacggatgccagagggactggggagcactcacttcacttgtgtgggtgtgctttccactagctgttcttacttggactgaggacaagggcaaagcatgattgtatcccaggaaactggggcttgccctgtgtgtggcacaagcatcatgtcttgcctgtataaagccttttggtcctctg

SEQ ID NO: 299142 - DNA, 103 bp, Homo sapiens
cataatgattgttgtatatccgttgataagaatctgaaatatatgggcttttatattgtttattttcatctcagtcttggggggggaattattacactgtttt

SEQ ID NO: 299143 - DNA, 1935 bp, Homo sapiens
gtgcgggaggcctccccaccttcctgtgccctctgccctctgcccttgcacacacttgttaccttcaggctgcttggccacccaggcctgaagaagccttctgaggctctcaccccatcagaacggccattttcactgaggagccagttttttccatttgccatggagctggtttggctggaacctggcctttgtagggaaaacggggagactcaggagccagactcactcttgggacaaatgagaaagagctgagccagtcgttcctgtcggaagggcgggcctgctcatcctggcgagaatttgcttttctgctttataggggattgcaggccaggcccactgacaggagcaccttgagaaccacctgaacacaagagaatgagggtgccccaaagtggaaggaagcttctggcccctgggccgttttgggaagggcccaggatactcacgggggctgaagggcaatgtgaagagtgactgcaagtcctggcattttctgtggtgtcagcaaatgcccctttattttaaatgattccagacatctgggcagcatagcttggccaccatcactcaggcttgatcctgctgttgagctgctcctgtctcctgtttacctcactcctgttgggaaggccatcgcatgctcctaggctccagagtcccctgtaggtctctaccagcaggtcgcctctgggagaacgtttcatcttcaggctctagaaactcctgttgcggaattgctggctttagtagaaaagatatgtcaggatttagaaatcgtattgaactctcctggacttctgctccatgatttcattttgctttcacgaaccagcgatccctaccttggggtgggaaattcaattgtaggcagcaaataactcaaccctcctgtaacccctgaggattataacgaccccatgacccccgatgacagccagcagtttggtgactagagttttttgagcctgccattctcagtagcagctttggtctggagatggaacgtggagcagggaatctgacagccacgtttctcgtgatcacgtggactggagttgtttttgttatctggggtggaaaattgcaatgatcaagtttcttttttattttttttttacttagaaaagcaaatattgtgtttttgtaataaatccctttcagcaaaattgcggaggatcattcatccactagggccccacctgaggcacagcgctgactcatcacggtggtaccagtaggtcagccatctggaaacagaagtggccctaattgggccaaaatgtggtaagactcgctggcctcaggcagggccaggccagttccctcacttctctgcacacctattcccagattccatccagagcaaagctgatgtttatcgtctcattgtacttaggctttcgtactttaaaaaattatgactttttaaaaataagccttcagcagacagaagtgaagaaatttagcctgggttgcctcagcaacaaagtctgcggttcctaagagccacatgttggggaagtggggtgacccaaacttggtgacataggttgattgatcagaccctcagccttacaagcaagagctcatgcagatccacagagccatgcacatcctgtcttcctgaccttcctcaggtggcaccacctgcgccccatggacctgctgtatcggtgtcatgtggaggtctgatgaatcctttaaaacctaactgtgatgtcgtaaatgtaactgtgctacctttatatctactgaagggcagcgtctgcatccgagggaaattcaacatgaaacaaccatcgttttagttgcactcagtctgtccatatgacatacacatgaagtgaatgtttccttatgttttcaggtctacaatgtttagtacatgtaaataaggaaaaaatttgataaatatggtaaattaagtta

SEQ ID NO: 299144 - DNA, 2288 bp, Homo sapiens
gtgcgggaggcctccccaccttcctgtgccctctgccctctgcccttgcacacacttgttaccttcaggctgcttggccacccaggcctgaagaagccttctgaggctctcaccccatcagaacggccattttcactgaggagccagttttttccatttgccatggagctggtttggctggaacctggcctttgtagggaaaacggggagactcaggagccagactcactcttgggacaaatgagaaagagctgagccagtcgttcctgtcggaagggcgggcctgctcatcctggcgagaatttgcttttctgctttataggggattgcaggccaggcccactgacaggagcaccttgagaaccacctgaacacaagagaatgagggtgccccaaagtggaaggaagcttctggcccctgggccgttttgggaagggcccaggatactcacgggggctgaagggcaatgtgaagagtgactgcaagtcctggcattttctgtggtgtcagcaaatgcccctttattttaaatgattccagacatctgggcagcatagcttggccaccatcactcaggcttgatcctgctgttgagctgctcctgtctcctgtttacctcactcctgttgggaaggccatcgcatgctcctaggctccagagtcccctgtaggtctctaccagcaggtcgcctctgggagaacgtttcatcttcaggctctagaaactcctgttgcggaattgctggctttagtagaaaagatatgtcaggatttagaaatcgtattgaactctcctggacttctgctccatgatttcattttgctttcacgaaccagcgatccctaccttggggtgggaaattcaattgtaggcagcaaataactcaaccctcctgtaacccctgaggattataacgaccccatgacccccgatgacagccagcagtttggtgactagagttttttgagcctgccattctcagtagcagctttggtctggagatggaacgtggagcagggaatctgacagccacgtttctcgtgatcacgtggactggagttgtttttgttatctggggtggaaaattgcaatgatcaagtttcttttttattttttttttacttagaaaagcaaatattgtgtttttgtaataaatccctttcagcaaaattgcggaggatcattcatccactagggccccacctgaggcacagcgctgactcatcacggtggtaccagtaggtcagccatctggaaacagaagtggccctaattgggccaaaatgtggtaagactcgctggcctcaggcagggccaggccagttccctcacttctctgcacacctattcccagattccatccagagcaaagctgatgtttatcgtctcattgtacttaggctttcgtactttaaaaaattatgactttttaaaaataagccttcagcagacagaagtgaagaaatttagcctgggttgcctcagcaacaaagtctgcggttcctaagagccacatgttggggaagtggggtgacccaaacttggtgacataggttgattgatcagaccctcagccttacaagcaagagctcatgcagatccacagagccatgcacatcctgtcttcctgaccttcctcaggtggcaccacctgcgccccatggacctgctgtatcggtgtcatgtggaggtctgatgaatcctttaaaacctaactgtgatgtcgtaaatgtaactgtgctacctttatatctactgaagggcagcgtctgcatccgagggaaattcaacatgaaacaaccatcgttttagttgcactcagtctgtccatatgacatacacatgaagtgaatgtttccttatgttttcaggtctacaatgtttagtacatgtaaataaggaaaaaatttgataaatatggtaaattaagttatagcgtgtcatttgattcttattttgctgtctcttgttatttaattttcctaatgctccacatctaggttccttcctaggtggtgggaacaccttgcagacgtgtgtgcaccaggacacaccgcggcccaggcagccacaccgagaaagcacacatctccactgatggcagccacccgactctccagttaacctcttttactctttaattctgatttactgtgatgatttaataaagtggaaacacagcacttcagtgctatatgtttctctcattctcattatagtttataagaaaataaagttcaccctggcatctaataaaaaggtggctttcatttttattggacagaa

SEQ ID NO: 299145 - DNA, 2254 bp, Homo sapiens
gtgcgggaggcctccccaccttcctgtgccctctgccctctgcccttgcacacacttgttaccttcaggctgcttggccacccaggcctgaagaagccttctgaggctctcaccccatcagaacggccattttcactgaggagccagttttttccatttgccatggagctggtttggctggaacctggcctttgtagggaaaacggggagactcaggagccagactcactcttgggacaaatgagaaagagctgagccagtcgttcctgtcggaagggcgggcctgctcatcctggcgagaatttgcttttctgctttataggggattgcaggccaggcccactgacaggagcaccttgagaaccacctgaacacaagagaatgagggtgccccaaagtggaaggaagcttctggcccctgggccgttttgggaagggcccaggatactcacgggggctgaagggcaatgtgaagagtgactgcaagtcctggcattttctgtggtgtcagcaaatgcccctttattttaaatgattccagacatctgggcagcatagcttggccaccatcactcaggcttgatcctgctgttgagctgctcctgtctcctgtttacctcactcctgttgggaaggccatcgcatgctcctaggctccagagtcccctgtaggtctctaccagcaggtcgcctctgggagaacgtttcatcttcaggctctagaaactcctgttgcggaattgctggctttagtagaaaagatatgtcaggatttagaaatcgtattgaactctcctggacttctgctccatgatttcattttgctttcacgaaccagcgatccctaccttggggtgggaaattcaattgtaggcagcaaataactcaaccctcctgtaacccctgaggattataacgaccccatgacccccgatgacagccagcagtttggtgactagagttttttgagcctgccattctcagtagcagctttggtctggagatggaacgtggagcagggaatctgacagccacgtttctcgtgatcacgtggactggagttgtttttgttatctggggtggaaaattgcaatgatcaagtttcttttttattttttttttacttagaaaagcaaatattgtgtttttgtaataaatccctttcagcaaaattgcggaggatcattcatccactagggccccacctgaggcacagcgctgactcatcacggtggtaccagtaggtcagccatctggaaacagaagtggccctaattgggccaaaatgtggtaagactcgctggcctcaggcagggccaggccagttccctcacttctctgcacacctattcccagattccatccagagcaaagctgatgtttatcgtctcattgtacttaggctttcgtactttaaaaaattatgactttttaaaaataagccttcagcagacagaagtgaagaaatttagcctgggttgcctcagcaacaaagtctgcggttcctaagagccacatgttggggaagtggggtgacccaaacttggtgacataggttgattgatcagaccctcagccttacaagcaagagctcatgcagatccacagagccatgcacatcctgtcttcctgaccttcctcaggtggcaccacctgcgccccatggacctgctgtatcggtgtcatgtggaggtctgatgaatcctttaaaacctaactgtgatgtcgtaaatgtaactgtgctacctttatatctactgaagggcagcgtctgcatccgagggaaattcaacatgaaacaaccatcgttttagttgcactcagtctgtccatatgacatacacatgaagtgaatgtttccttatgttttcaggtctacaatgtttagtacatgtaaataaggaaaaaatttgataaatatggtaaattaagttatagcgtgtcatttgattcttattttgctgtctcttgttatttaattttcctaatgctccacatctaggttccttcctaggtggtgggaacaccttgcagacgtgtgtgcaccaggacacaccgcggcccaggcagccacaccgagaaagcacacatctccactgatggcagccacccgactctccagttaacctcttttactctttaattctgatttactgtgatgatttaataaagtggaaacacagcacttcagtgctatatgtttctctcattctcattatagtttataagaaaataaagttcaccctggcatcta

SEQ ID NO: 299146 - DNA, 4492 bp, Homo sapiens
tcctcttcttcttaaacaaaccacaaacggatgtgagggaaggaaggtgtttcttttactcctgagcccagacacctcactctgttccgtctaagcttgttttgctgaacacttttttttaaaaaaggaaaaagaaaaggagttgcttgatgtgagagtgaaatggacgtaagattttatccacctccagcccagcccgccgctgcgcccgacgctccctgtctgggaccttctccctgcctggacccctactattgcaacaagtttgacggtgagaacatgtatatgagcatgacagagccgagccaggactatgtgccagccagccagtcctaccctggtccaagcctggaaagtgaagacttcaacattccaccaattactcctccttccctcccagaccactcgctggtgcacctgaatgaagttgagtctggttaccattctctgtgtcaccccatgaaccataatggcctgctaccatttcatccacaaaacatggacctccctgaaatcacagtctccaatatgctgggccaggatggaacactgctttctaattccatttctgtgatgccagatatacgaaacccagaaggaactcagtacagttcccatcctcagatggcagccatgagaccaaggggccagcctgcagacatcaggcagcagccaggaatgatgccacatggccagctgactaccattaaccagtcacagctaagtgctcaacttggtttgaatatgggaggaagcaatgttccccacaactcaccatctccacctggaagcaagtctgcaactccttcaccatccagttcagtgcatgaagatgaaggcgatgatacctctaagatcaatggtggagagaagcggcctgcctctgatatggggaaaaaaccaaaaactcccaaaaagaagaagaagaaggatcccaatgagccccagaagcctgtgtctgcctatgcgttattctttcgtgatactcaggccgccatcaagggccaaaatccaaacgctacctttggcgaagtctctaaaattgtggcttcaatgtgggacggtttaggagaagagcaaaaacaggtctataaaaagaaaaccgaggctgcgaagaaggagtacctgaagcaactcgcagcatacagagccagccttgtatccaagagctacagtgaacctgttgacgtgaagacatctcaacctcctcagctgatcaattcgaagccgtcggtgttccatgggcccagccaggcccactcggccctgtacctaagttcccactatcaccaacaaccgggaatgaatcctcacctaactgccatgcatcctagtctccccaggaacatagcccccaagccgaataaccaaatgccagtgactgtctctatagcaaacatggctgtgtcccctcctcctcccctccagatcagcccgcctcttcaccagcatctcaacatgcagcagcaccagccgctcaccatgcagcagccccttgggaaccagctccccatgcaggtccagtctgccttacactcacccaccatgcagcaaggatttactcttcaacccgactatcagactattatcaatcctacatctacagctgcacaagttgtcacccaggcaatggagtatgtgcgttcggggtgcagaaatcctcccccacaaccggtggactggaataacgactactgcagtagtgggggcatgcagagggacaaagcactgtaccttacttgagaatctgaacacctcttctttccactgaggaattcagggaagtgttttcaccatggattgctttgtacagtcaaggcagttctccattttattagaaaatacaagttgctaagcacttaggaccatttgagcttgtgggtcacccactctggaagaaatagtcatgcttctttattatttttttaatcctttatggacattgtttttcttcttccctgaaggaaatttggaccattcagattttatgttggttttttgctgtgaagtgctgcgctctagtaactgccttagcaactgtagatgtctcggataaaagtcctggattttccattggttttcataatgggtgtttatatgaaactactaaagactttttaaatggcttgatgtagcagtcatagcaagtttgtaaatagcatctatgttacactctcctagagtataaaatgtgaatgtttttgtagctaaattgtaattgaaactggctcattccagtttattgatttcacaataggggttaaattggcaaacattcatatttttacttcatttttaaaacaactgactgatagttctatattttcaaaatatttgaaaataaaaagtattcccaagtgattttaatttaaaaacaaattggctttgtctcattgatcagacaaaaagaaactagtattaagggaagcgcaaacacatttattttgtactgcagaaaaattgcttttttgtatcactttttgtgtaatggttagtaaatgtcatttaagtccttttatgtataaaactgccaaatgcttacctggtattttattagatgcagaaacagattggaaacagctaaattacaacttttacatatggctctgtcttattgtttcttcatactgtgtctgtatttaatctttttttatggaacctgttgcgcctatttatgaaataataaatataggtgtttgtaagtaaatttgttagtatttgaaagaggtttctttgatgttttaacttttgctggcaaaaaaaaattcacgcttggtgtgaatactttattatttagtttttacagtaacatgaataaagccaaacctgcttttcatttagcagcaaattaaagtaaccagtccttatttctgcatttctttggttgatgcaaacaaaaaactattatatttaagaactttatttcttcatacgacataacagaattgccctccaagtcacacaagctccaagactaaacaaacagacaggtcctctgtcttaaaaaggttacttcttggttctcagctggttctagtcaattctgaaccaccaccccccgccccccgcaaaaaagtaaaagtcaaaccaaacttcctcaagctgcatgcttttcacaaaatccagaaagcatttaagaattgaactaggggctggaagaagtgaaagggaagcatctaaaaatgaaaggtgagtaaccagatagcaaaagaaaagggaaagccatccaaatttgaaagctgttgatagaaattgagattcttgctgtcttttgtgcctctacaagctactactcattccagaattcctgggtcttccaagaggattcttaaggtaccagagatttgctagggaaccaaaagtgcttgagaatctgcctgagggcttgcatagctttcacattaaaaaaagaaaaagctagcagatttactcctttttaggggatcatatcaagaaagttagtctggttggaaaccaagagaatggctgatgtctctttcttggaatatgtgaaataaatttagcagtttaactaaatacaaatatatgcattgtgtaatccactcagaattaaacagacaaaaggtatgcttgctttggaatgattttaggcattgtacaaccttgaatcacttgagcatgtaataactaataaataatgcagatccatgtgattattaaaatgactgtagctgagagctctaattttcctgtcttgaaactgtataagaactcatgtgattaagttcacagtttattgtttgtctgtttagtattttagaaatataccagcactactaattaactaatgtcttttatttattatattatgataaagtaaaaatttcacttgcattaagtctaaactgagaaggtaattactgggaggagaatgagcagctttgactttgacaggcggtttgtgcaggaaagcacagtgccgtgttgtttacagcttttctagagcagctgtgcgaccagggtagagagtgttgaaattcaataccaaatacagtaaaaacaaatgtaaataaaagaaaacacatcatcaataaaactgttattatgcgtgaccgtattctatttggtgatccatcagtctctaaaaagcaagcctagtcagatgagaaatcccaaataaattttatggtggaagtgatcgggcagagtgggggttaatggccgccatggccacaaatgttctttcctgaaactctgagaatgccctctcactaacctgaggctctagtatagtgagctgttgcctaggaaatccccatctttcagaaagccagaatccaccctgggcacagtagcccagcggcttggagcttgtagctgagaggaacagtgggggtgcacgccgagttctctgctgaagcactccgaagatttccagcaccatcagtaaagtcattctgagagataacagcaacactgtggaacgacagatttcttcaccaacacaccaaaaccaaaattatagctgatt

SEQ ID NO: 299147 - DNA, 3595 bp, Homo sapiens
tcctcttcttcttaaacaaaccacaaacggatgtgagggaaggaaggtgtttcttttactcctgagcccagacacctcactctgttccgtctaagcttgttttgctgaacacttttttttaaaaaaggaaaaagaaaaggagttgcttgatgtgagagtgaaatggacgtaagattttatccacctccagcccagcccgccgctgcgcccgacgctccctgtctgggaccttctccctgcctggacccctactattgcaacaagtttgacggtgagaacatgtatatgagcatgacagagccgagccaggactatgtgccagccagccagtcctaccctggtccaagcctggaaagtgaagacttcaacattccaccaattactcctccttccctcccagaccactcgctggtgcacctaactgccatgcatcctagtctccccaggaacatagcccccaagccgaataaccaaatgccagtgactgtctctatagcaaacatggctgtgtcccctcctcctcccctccagatcagcccgcctcttcaccagcatctcaacatgcagcagcaccagccgctcaccatgcagcagccccttgggaaccagctccccatgcaggtccagtctgccttacactcacccaccatgcagcaaggatttactcttcaacccgactatcagactattatcaatcctacatctacagctgcacaagttgtcacccaggcaatggagtatgtgcgttcggggtgcagaaatcctcccccacaaccggtggactggaataacgactactgcagtagtgggggcatgcagagggacaaagcactgtaccttacttgagaatctgaacacctcttctttccactgaggaattcagggaagtgttttcaccatggattgctttgtacagtcaaggcagttctccattttattagaaaatacaagttgctaagcacttaggaccatttgagcttgtgggtcacccactctggaagaaatagtcatgcttctttattatttttttaatcctttatggacattgtttttcttcttccctgaaggaaatttggaccattcagattttatgttggttttttgctgtgaagtgctgcgctctagtaactgccttagcaactgtagatgtctcggataaaagtcctggattttccattggttttcataatgggtgtttatatgaaactactaaagactttttaaatggcttgatgtagcagtcatagcaagtttgtaaatagcatctatgttacactctcctagagtataaaatgtgaatgtttttgtagctaaattgtaattgaaactggctcattccagtttattgatttcacaataggggttaaattggcaaacattcatatttttacttcatttttaaaacaactgactgatagttctatattttcaaaatatttgaaaataaaaagtattcccaagtgattttaatttaaaaacaaattggctttgtctcattgatcagacaaaaagaaactagtattaagggaagcgcaaacacatttattttgtactgcagaaaaattgcttttttgtatcactttttgtgtaatggttagtaaatgtcatttaagtccttttatgtataaaactgccaaatgcttacctggtattttattagatgcagaaacagattggaaacagctaaattacaacttttacatatggctctgtcttattgtttcttcatactgtgtctgtatttaatctttttttatggaacctgttgcgcctatttatgaaataataaatataggtgtttgtaagtaaatttgttagtatttgaaagaggtttctttgatgttttaacttttgctggcaaaaaaaaattcacgcttggtgtgaatactttattatttagtttttacagtaacatgaataaagccaaacctgcttttcatttagcagcaaattaaagtaaccagtccttatttctgcatttctttggttgatgcaaacaaaaaactattatatttaagaactttatttcttcatacgacataacagaattgccctccaagtcacacaagctccaagactaaacaaacagacaggtcctctgtcttaaaaaggttacttcttggttctcagctggttctagtcaattctgaaccaccaccccccgccccccgcaaaaaagtaaaagtcaaaccaaacttcctcaagctgcatgcttttcacaaaatccagaaagcatttaagaattgaactaggggctggaagaagtgaaagggaagcatctaaaaatgaaaggtgagtaaccagatagcaaaagaaaagggaaagccatccaaatttgaaagctgttgatagaaattgagattcttgctgtcttttgtgcctctacaagctactactcattccagaattcctgggtcttccaagaggattcttaaggtaccagagatttgctagggaaccaaaagtgcttgagaatctgcctgagggcttgcatagctttcacattaaaaaaagaaaaagctagcagatttactcctttttaggggatcatatcaagaaagttagtctggttggaaaccaagagaatggctgatgtctctttcttggaatatgtgaaataaatttagcagtttaactaaatacaaatatatgcattgtgtaatccactcagaattaaacagacaaaaggtatgcttgctttggaatgattttaggcattgtacaaccttgaatcacttgagcatgtaataactaataaataatgcagatccatgtgattattaaaatgactgtagctgagagctctaattttcctgtcttgaaactgtataagaactcatgtgattaagttcacagtttattgtttgtctgtttagtattttagaaatataccagcactactaattaactaatgtcttttatttattatattatgataaagtaaaaatttcacttgcattaagtctaaactgagaaggtaattactgggaggagaatgagcagctttgactttgacaggcggtttgtgcaggaaagcacagtgccgtgttgtttacagcttttctagagcagctgtgcgaccagggtagagagtgttgaaattcaataccaaatacagtaaaaacaaatgtaaataaaagaaaacacatcatcaataaaactgttattatgcgtgaccgtattctatttggtgatccatcagtctctaaaaagcaagcctagtcagatgagaaatcccaaataaattttatggtggaagtgatcgggcagagtgggggttaatggccgccatggccacaaatgttctttcctgaaactctgagaatgccctctcactaacctgaggctctagtatagtgagctgttgcctaggaaatccccatctttcagaaagccagaatccaccctgggcacagtagcccagcggcttggagcttgtagctgagaggaacagtgggggtgcacgccgagttctctgctgaagcactccgaagatttccagcaccatcagtaaagtcattctgagagataacagcaacactgtggaacgacagatttcttcaccaacacaccaaaaccaaaattatagctgatt

SEQ ID NO: 299148 - DNA, 4421 bp, Homo sapiens
cggacgcgtgggtcgacccacgcgcttgttttgctgaacacttttttttaaaaaaggaaaaagaaaaggagttgcttgatgtgagagtgaaatggacgtaagattttatccacctccagcccagcccgccgctgcgcccgacgctccctgtctgggaccttctccctgcctggacccctactattgcaacaagtttgacggtgagaacatgtatatgagcatgacagagccgagccaggactatgtgccagccagccagtcctaccctggtccaagcctggaaagtgaagacttcaacattccaccaattactcctccttccctcccagaccactcgctggtgcacctgaatgaagttgagtctggttaccattctctgtgtcaccccatgaaccataatggcctgctaccatttcatccacaaaacatggacctccctgaaatcacagtctccaatatgctgggccaggatggaacactgctttctaattccatttctgtgatgccagatatacgaaacccagaaggaactcagtacagttcccatcctcagatggcagccatgagaccaaggggccagcctgcagacatcaggcagcagccaggaatgatgccacatggccagctgactaccattaaccagtcacagctaagtgctcaacttggtttgaatatgggaggaagcaatgttccccacaactcaccatctccacctggaagcaagtctgcaactccttcaccatccagttcagtgcatgaagatgaaggcgatgatacctctaagatcaatggtggagagaagcggcctgcctctgatatggggaaaaaaccaaaaactcccaaaaagaagaagaagaaggatcccaatgagccccagaagcctgtgtctgcctatgcgttattctttcgtgatactcaggccgccatcaagggccaaaatccaaacgctacctttggcgaagtctctaaaattgtggcttcaatgtgggacggtttaggagaagagcaaaaacaggtctataaaaagaaaaccgaggctgcgaagaaggagtacctgaagcaactcgcagcatacagagccagccttgtatccaagagctacagtgaacctgttgacgtgaagacatctcaacctcctcagctgatcaattcgaagccgtcggtgttccatgggcccagccaggcccactcggccctgtacctaagttcccactatcaccaacaaccgggaatgaatcctcacctaactgccatgcatcctagtctccccaggaacatagcccccaagccgaataaccaaatgccagtgactgtctctatagcaaacatggctgtgtcccctcctcctcccctccagatcagcccgcctcttcaccagcatctcaacatgcagcagcaccagccgctcaccatgcagcagccccttgggaaccagctccccatgcaggtccagtctgccttacactcacccaccatgcagcaaggatttactcttcaacccgactatcagactattatcaatcctacatctacagctgcacaagttgtcacccaggcaatggagtatgtgcgttcggggtgcagaaatcctcccccacaaccggtggactggaataacgactactgcagtagtgggggcatgcagagggacaaagcactgtaccttacttgagaatctgaacacctcttctttccactgaggaattcagggaagtgttttcaccatggattgctttgtacagtcaaggcagttctccattttattagaaaatacaagttgctaagcacttaggaccatttgagcttgtgggtcacccactctggaagaaatagtcatgcttctttattatttttttaatcctttatggacattgtttttcttcttccctgaaggaaatttggaccattcagattttatgttggttttttgctgtgaagtgctgcgctctagtaactgccttagcaactgtagatgtctcggataaaagtcctggattttccattggttttcataatgggtgtttatatgaaactactaaagactttttaaatggcttgatgtagcagtcatagcaagtttgtaaatagcatctatgttacactctcctagagtataaaatgtgaatgtttttgtagctaaattgtaattgaaactggctcattccagtttattgatttcacaataggggttaaattggcaaacattcatatttttacttcatttttaaaacaactgactgatagttctatattttcaaaatatttgaaaataaaaagtattcccaagtgattttaatttaaaaacaaattggctttgtctcattgatcagacaaaaagaaactagtattaagggaagcgcaaacacatttattttgtactgcagaaaaattgcttttttgtatcactttttgtgtaatggttagtaaatgtcatttaagtccttttatgtataaaactgccaaatgcttacctggtattttattagatgcagaaacagattggaaacagctaaattacaacttttacatatggctctgtcttattgtttcttcatactgtgtctgtatttaatctttttttatggaacctgttgcgcctatttatgaaataataaatataggtgtttgtaagtaaatttgttagtatttgaaagaggtttctttgatgttttaacttttgctggcaaaaaaaaattcacgcttggtgtgaatactttattatttagtttttacagtaacatgaataaagccaaacctgcttttcatttagcagcaaattaaagtaaccagtccttatttctgcatttctttggttgatgcaaacaaaaaactattatatttaagaactttatttcttcatacgacataacagaattgccctccaagtcacacaagctccaagactaaacaaacagacaggtcctctgtcttaaaaaggttacttcttggttctcagctggttctagtcaattctgaaccaccaccccccgccccccgcaaaaaagtaaaagtcaaaccaaacttcctcaagctgcatgcttttcacaaaatccagaaagcatttaagaattgaactaggggctggaagaagtgaaagggaagcatctaaaaatgaaaggtgagtaaccagatagcaaaagaaaagggaaagccatccaaatttgaaagctgttgatagaaattgagattcttgctgtcttttgtgcctctacaagctactactcattccagaattcctgggtcttccaagaggattcttaaggtaccagagatttgctagggaaccaaaagtgcttgagaatctgcctgagggcttgcatagctttcacattaaaaaaagaaaaagctagcagatttactcctttttaggggatcatatcaagaaagttagtctggttggaaaccaagagaatggctgatgtctctttcttggaatatgtgaaataaatttagcagtttaactaaatacaaatatatgcattgtgtaatccactcagaattaaacagacaaaaggtatgcttgctttggaatgattttaggcattgtacaaccttgaatcacttgagcatgtaataactaataaataatgcagatccatgtgattattaaaatgactgtagctgagagctctaattttcctgtcttgaaactgtataagaactcatgtgattaagttcacagtttattgtttgtctgtttagtattttagaaatataccagcactactaattaactaatgtcttttatttattatattatgataaagtaaaaatttcacttgcattaagtctaaactgagaaggtaattactgggaggagaatgagcagctttgactttgacaggcggtttgtgcaggaaagcacagtgccgtgttgtttacagcttttctagagcagctgtgcgaccagggtagagagtgttgaaattcaataccaaatacagtaaaaacaaatgtaaataaaagaaaacacatcatcaataaaactgttattatgcgtgaccgtattctatttggtgatccatcagtctctaaaaagcaagcctagtcagatgagaaatcccaaataaattttatggtggaagtgatcgggcagagtgggggttaatggccgccatggccacaaatgttctttcctgaaactctgagaatgccctctcactaacctgaggctctagtatagtgagctgttgcctaggaaatccccatctttcagaaagccagaatccaccctgggcacagtagcccagcggcttggagcttgtagctgagaggaacagtgggggtgcacgccgagttctctgctgaagcactccgaagatttccagcaccatcagtaaagtcattctgagagataacagcaacactgtggaacgacagatttcttcaccaacacaccaaaaccaaaattatagctgatt

SEQ ID NO: 299149 - DNA, 2775 bp, Homo sapiens
cggacgcgtgggtcgacccacgcgcttgttttgctgaacacttttttttaaaaaaggaaaaagaaaaggagttgcttgatgtgagagtgaaatggacgtaagattttatccacctccagcccagcccgccgctgcgcccgacgctccctgtctgggaccttctccctgcctggacccctactattgcaacaagtttgacggtgagaacatgtatatgagcatgacagagccgagccaggactatgtgccagccagccagtcctaccctggtccaagcctggaaagtgaagacttcaacattccaccaattactcctccttccctcccagaccactcgctggtgcacctgaatgaagttgagtctggttaccattctctgtgtcaccccatgaaccataatggcctgctaccatttcatccacaaaacatggacctccctgaaatcacagtctccaatatgctgggccaggatggaacactgctttctaattccatttctgtgatgccagatatacgaaacccagaaggaactcagtacagttcccatcctcagatggcagccatgagaccaaggggccagcctgcagacatcaggcagcagccaggaatgatgccacatggccagctgactaccattaaccagtcacagctaagtgctcaacttggtttgaatatgggaggaagcaatgttccccacaactcaccatctccacctggaagcaagtctgcaactccttcaccatccagttcagtgcatgaagatgaaggcgatgatacctctaagatcaatggtggagagaagcggcctgcctctgatatggggaaaaaaccaaaaactcccaaaaagaagaagaagaaggatcccaatgagccccagaagcctgtgtctgcctatgcgttattctttcgtgatactcaggccgccatcaagggccaaaatccaaacgctacctttggcgaagtctctaaaattgtggcttcaatgtgggacggtttaggagaagagcaaaaacaggtctataaaaagaaaaccgaggctgcgaagaaggagtacctgaagcaactcgcagcatacagagccagccttgtatccaagagctacagtgaacctgttgacgtgaagacatctcaacctcctcagctgatcaattcgaagccgtcggtgttccatgggcccagccaggcccactcggccctgtacctaagttcccactatcaccaacaaccgggaatgaatcctcacctaactgccatgcatcctagtctccccaggaacatagcccccaagccgaataaccaaatgccagtgactgtctctatagcaaacatggctgtgtcccctcctcctcccctccagatcagcccgcctcttcaccagcatctcaacatgcagcagcaccagccgctcaccatgcagcagccccttgggaaccagctccccatgcaggtccagtctgccttacactcacccaccatgcagcaaggatttactcttcaacccgactatcagactattatcaatcctacatctacagctgcacaagttgtcacccaggcaatggagtatgtgcgttcggggtgcagaaatcctcccccacaaccggtggactggaataacgactactgcagtagtgggggcatgcagagggacaaagcactgtaccttacttgagaatctgaacacctcttctttccactgaggaattcagggaagtgttttcaccatggattgctttgtacagtcaaggcagttctccattttattagaaaatacaagttgctaagcacttaggaccatttgagcttgtgggtcacccactctggaagaaatagtcatgcttctttattatttttttaatcctttatggacattgtttttcttcttccctgaaggaaatttggaccattcagattttatgttggttttttgctgtgaagtgctgcgctctagtaactgccttagcaactgtagatgtctcggataaaagtcctggattttccattggttttcataatgggtgtttatatgaaactactaaagactttttaaatggcttgatgtagcagtcatagcaagtttgtaaatagcatctatgttacactctcctagagtataaaatgtgaatgtttttgtagctaaattgtaattgaaactggctcattccagtttattgatttcacaataggggttaaattggcaaacattcatatttttacttcatttttaaaacaactgactgatagttctatattttcaaaatatttgaaaataaaaagtattcccaagtgattttaatttaaaaacaaattggctttgtctcattgatcagacaaaaagaaactagtattaagggaagcgcaaacacatttattttgtactgcagaaaaattgcttttttgtatcactttttgtgtaatggttagtaaatgtcatttaagtccttttatgtataaaactgccaaatgcttacctggtattttattagatgcagaaacagattggaaacagctaaattacaacttttacatatggctctgtcttattgtttcttcatactgtgtctgtatttaatctttttttatggaacctgttgcgcctatttatgaaataataaatataggtgtttgtaagtaaatttgttagtatttgaaagaggtttctttgatgttttaacttttgctggcaaaaaaaaattcacgcttggtgtgaatactttattatttagtttttacagtaacatgaataaagccaaacctgcttttcatttagcagca

SEQ ID NO: 299150 - DNA, 651 bp, Homo sapiens
tctagtctattgccatacttcttaaaaatctgtttcagtaagaaaacacaatctttggggagatatatattattatattatataactataagtgtgtttgtgtgtgcagttatcattctatattgtacttctctgaaaacaaaagcaaatgcactttctaatttaagactctttgctgttgttgcaggtctataaaaagaaaaccgaggctgcgaagaaggagtacctgaagcaactcgcagcatacagagccagccttgtatccaaggtaacgtgcagttgtgtgatattgtgaaggattgtggccatctcggcgcagactttgatagtcacttaaaggcataaaagatcactttaacgattctgcacaatcttctttgttggaaaaaaaagtaaattacaaacaaagctatacgatatggaaatattcgttcagctccaaaagaccagagcagcatcccctgggccatttctaaaatattgtccacctgtggatgattggttttgtggattagtcacagtacattcttcaacctgagccaactttctacttctccatatccctttcttaaattgcctccaggcccccatgccattggcctttactgaggacatgccaactctaagttctagactcattacagcagcatt

SEQ ID NO: 299151 - DNA, 457 bp, Homo sapiens
tttttcctttcctgaaagcctcatctaccttaatttcacacattattcctcgttttgactggctctatcaggataaattgacccttgcttcccatggtatttatggcatttatccttggggtagagccagtaccgacaatcaccatcccaaagctacgaggatgcgatggtaacatgctcatcagccatctacttaacactttgcccaagcctagtcccgtttcatcatcccagcaacttgatgagttaggtgcagatgagaaaaccaagaatgacagaagtttatccaaggccatacatcagaccaacggtctcaaacatgggaccgccttcagtactttccaatgagctgggtacccactaaaaaaaaaaaaaaaaaaaatcaaaatctaccattccacttggttctatgtggaatgatgtggcaaatcatgatttctaatcatttagtgtagat

SEQ ID NO: 299152 - DNA, 999 bp, Homo sapiens
agcggggagaggcctggcgcacagggcgagggcggctgcggcgcagtctgcagcatggcgtacccggggcatcctggcgccggcggcgggtactacccaggcgggtatggaggggctcccggagggcctgcgtttcccggacaaactcaggatccgctgtatggttactttgctgctgtagctggacaggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttgttcctttgggaaactttttaaaaacaaaccaccaccacaatcccccacacccactaaaacacacacctcacacacacaacaccacatcaacaacaaaacacaacggaggggggggggcgccacaataaaatccccccaggaggagccccaatctgcgccacacccttt

SEQ ID NO: 299153 - DNA, 757 bp, Homo sapiens
agcggggagaggcctggcgcacagggcgagggcggctgcggcgcagtctgcagcatggcgtacccggggcatcctggcgccggcggcgggtactacccaggcgggtatggaggggctcccggagggcctgcgtttcccggacaaactcaggatccgctgtatggttactttgctgctgtagctggacaggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctc

SEQ ID NO: 299154 - DNA, 919 bp, Homo sapiens
agcggggagaggcctggcgcacagggcgagggcggctgcggcgcagtctgcagcatggcgtacccggggcatcctggcgccggcggcgggtactacccaggcgggtatggaggggctcccggagggcctgcgtttcccggacaaactcaggatccgctgtatggttactttgctgctgtagctggacaggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatgtaagtcttagaaattaagagatacagtagatgaaaaggatgtacaccagatgggtatccctttgaaattagctgttaagaatatcttaaggttaaggatgccagagacataagggattcaaaagttagaaagagttatcatccagaatttattaatttccatttattagtcttaactatagtgagaccatgatttgatttgcattcagagacctgggttcaagacccagcttgttgtatttattagctgggtcacttaagcaggtttcttaattgctgtgacactatatgaata

SEQ ID NO: 299155 - DNA, 2032 bp, Homo sapiens
agcggggagaggcctggcgcacagggcgagggcggctgcggcgcagtctgcagcatggcgtacccggggcatcctggcgccggcggcgggtactacccaggcgggtatggaggggctcccggagggcctgcgtttcccggacaaactcaggatccgctgtatggttactttgctgctgtagctggacaggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacactttaaaaaatacacatagcagagtatcggaaagtatgtaccaaaacattgatctggctaccactgggagtcaggatcatgagttcatcttcttccttcttactgcttttccaaacattctccagtaagcaggtactacatttataatggaaggaattttttaaaaaattttaagctgtacactttcaagtaagatctgaattctaatgctggcttgtgcctcttactatgtggtttggtcattatagataatgcccagtttcagtttccccatctttgaaaaggagataatatgttatctcttgggagtagttctgaatatgaagtgtgttgatacaagaagcactgacaatgtttctgtttcttaaatttaaaactggcctggtttgccttttttatcaagagagcttaacagataaaaaatgaaattagtctattttctacttgccagcagagtatctgtcttattttaggatgcagtgtgaaacttaccattcaactgaacaactagttgtcaactaatgaaaataaaacattttctctaagcatctttagcctcatttcac

SEQ ID NO: 299156 - DNA, 1995 bp, Homo sapiens
actctgcaagaaggcaatcctctaaggatcaccagcttctacctataagacttcaactcaagatgcagtatggaggggctcccggagggcctgcgtttcccggacaaactcaggatccgctgtatggttactttgctgctgtagctggacaggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacactttaaaaaatacacatagcagagtatcggaaagtatgtaccaaaacattgatctggctaccactgggagtcaggatcatgagttcatcttcttccttcttactgcttttccaaacattctccagtaagcaggtactacatttataatggaaggaattttttaaaaaattttaagctgtacactttcaagtaagatctgaattctaatgctggcttgtgcctcttactatgtggtttggtcattatagataatgcccagtttcagtttccccatctttgaaaaggagataatatgttatctcttgggagtagttctgaatatgaagtgtgttgatacaagaagcactgacaatgtttctgtttcttaaatttaaaactggcctggtttgccttttttatcaagagagcttaacagataaaaaatgaaattagtctattttctacttgccagcagagtatctgtcttattttaggatgcagtgtgaaacttaccattcaactgaacaactagttgtcaactaatgaaaataaaacattttctctaagcatctttagcctcatttcac

SEQ ID NO: 299157 - DNA, 1939 bp, Homo sapiens
cctgtttcacagtatggaggggctcccggagggcctgcgtttcccggacaaactcaggatccgctgtatggttactttgctgctgtagctggacaggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacactttaaaaaatacacatagcagagtatcggaaagtatgtaccaaaacattgatctggctaccactgggagtcaggatcatgagttcatcttcttccttcttactgcttttccaaacattctccagtaagcaggtactacatttataatggaaggaattttttaaaaaattttaagctgtacactttcaagtaagatctgaattctaatgctggcttgtgcctcttactatgtggtttggtcattatagataatgcccagtttcagtttccccatctttgaaaaggagataatatgttatctcttgggagtagttctgaatatgaagtgtgttgatacaagaagcactgacaatgtttctgtttcttaaatttaaaactggcctggtttgccttttttatcaagagagcttaacagataaaaaatgaaattagtctattttctacttgccagcagagtatctgtcttattttaggatgcagtgtgaaacttaccattcaactgaacaactagttgtcaactaatgaaaataaaacattttctctaagcatctttagcctcatttcac

SEQ ID NO: 299158 - DNA, 1948 bp, Homo sapiens
agcggggagaggcctggcgcacagggcgagggcggctgcggcgcagtctgcagcatggcgtacccggggcatcctggcgccggcggcgggtactacccaggcggggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacactttaaaaaatacacatagcagagtatcggaaagtatgtaccaaaacattgatctggctaccactgggagtcaggatcatgagttcatcttcttccttcttactgcttttccaaacattctccagtaagcaggtactacatttataatggaaggaattttttaaaaaattttaagctgtacactttcaagtaagatctgaattctaatgctggcttgtgcctcttactatgtggtttggtcattatagataatgcccagtttcagtttccccatctttgaaaaggagataatatgttatctcttgggagtagttctgaatatgaagtgtgttgatacaagaagcactgacaatgtttctgtttcttaaatttaaaactggcctggtttgccttttttatcaagagagcttaacagataaaaaatgaaattagtctattttctacttgccagcagagtatctgtcttattttaggatgcagtgtgaaacttaccattcaactgaacaactagttgtcaactaatgaaaataaaacattttctctaagcatctttagcctcatttcac

SEQ ID NO: 299159 - DNA, 2133 bp, Homo sapiens
ggtgcatctttccaatgagtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggttagcagatgtttaattttttttttaacaacattaacttgtggcctctttctacacctggaaatttactcttgaataaataaaaactcgtttgtcttgtcttctgccagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacactttaaaaaatacacatagcagagtatcggaaagtatgtaccaaaacattgatctggctaccactgggagtcaggatcatgagttcatcttcttccttcttactgcttttccaaacattctccagtaagcaggtactacatttataatggaaggaattttttaaaaaattttaagctgtacactttcaagtaagatctgaattctaatgctggcttgtgcctcttactatgtggtttggtcattatagataatgcccagtttcagtttccccatctttgaaaaggagataatatgttatctcttgggagtagttctgaatatgaagtgtgttgatacaagaagcactgacaatgtttctgtttcttaaatttaaaactggcctggtttgccttttttatcaagagagcttaacagataaaaaatgaaattagtctattttctacttgccagcagagtatctgtcttattttaggatgcagtgtgaaacttaccattcaactgaacaactagttgtcaactaatgaaaataaaacattttctctaagcatctttagcctcatttcac

SEQ ID NO: 299160 - DNA, 1850 bp, Homo sapiens
gggctcgtcttagatctacatgctgatgtgcttgccttgatgctcggacgtcgtctggcatgtcggaggtagcaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacactttaaaaaatacacatagcagagtatcggaaagtatgtaccaaaacattgatctggctaccactgggagtcaggatcatgagttcatcttcttccttcttactgcttttccaaacattctccagtaagcaggtactacatttataatggaaggaattttttaaaaaattttaagctgtacactttcaagtaagatctgaattctaatgctggcttgtgcctcttactatgtggtttggtcattatagataatgcccagtttcagtttccccatctttgaaaaggagataatatgttatctcttgggagtagttctgaatatgaagtgtgttgatacaagaagcactgacaatgtttctgtttcttaaatttaaaactggcctggtttgccttttttatcaagagagcttaacagataaaaaatgaaattagtctattttctacttgccagcagagtatctgtcttattttaggatgcagtgtgaaacttaccattcaactgaacaactagttgtcaactaatgaaaataaaacattttctctaagcatctttagcctcatttcac

SEQ ID NO: 299161 - DNA, 1816 bp, Homo sapiens
aggtctgactagaggatccccatggcatgtagtgaggacacaaactttaaccgggagacttgccggcttatggtttcaaggctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacactttaaaaaatacacatagcagagtatcggaaagtatgtaccaaaacattgatctggctaccactgggagtcaggatcatgagttcatcttcttccttcttactgcttttccaaacattctccagtaagcaggtactacatttataatggaaggaattttttaaaaaattttaagctgtacactttcaagtaagatctgaattctaatgctggcttgtgcctcttactatgtggtttggtcattatagataatgcccagtttcagtttccccatctttgaaaaggagataatatgttatctcttgggagtagttctgaatatgaagtgtgttgatacaagaagcactgacaatgtttctgtttcttaaatttaaaactggcctggtttgccttttttatcaagagagcttaacagataaaaaatgaaattagtctattttctacttgccagcagagtatctgtcttattttaggatgcagtgtgaaacttaccattcaactgaacaactagttgtcaactaatgaaaataaaacattttctctaagcatctttagcctcatttcac

SEQ ID NO: 299162 - DNA, 2211 bp, Homo sapiens
taacattgattcctctgcaagtgatgggatttttcacatcccacttgttggactgagtttaggtagtgctgactatccagtgcattccatcccacctcatttgtctgggggcactaaacaagggaatattagtaccagagatgatgctaggacagaagggcaaacagcatagcctgaagcacccacaaagtacagcctagttccagtaacaagaccgctttttataagtggttcacaatggcaacgctatttccttataatcaagtcatgtaagttatcttttccccacagtaaaaattggcacttgagctttttctccatagcccctttctatttttaaatcattaattttacatcataccaagaataatctacaataacttttttagccattgaatattgaattccccttatccttgatctttcatttaatccttagaaaatatcgcaaaatacagctctaatccttgattacagttcagagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacactttaaaaaatacacatagcagagtatcggaaagtatgtaccaaaacattgatctggctaccactgggagtcaggatcatgagttcatcttcttccttcttactgcttttccaaacattctccagtaagcaggtactacatttataatggaaggaattttttaaaaaattttaagctgtacactttcaagtaagatctgaattctaatgctggcttgtgcctcttactatgtggtttggtcattatagataatgcccagtttcagtttccccatctttgaaaaggagataatatgttatctcttgggagtagttctgaatatgaagtgtgttgatacaagaagcactgacaatgtttctgtttcttaaatttaaaactggcctggtttgccttttttatcaagagagcttaacagataaaaaatgaaattagtctattttctacttgccagcagagtatctgtcttattttaggatgcagtgtgaaacttaccattcaactgaacaactagttgtcaactaatgaaaataaaacattttctctaagcatctttagcctcatttcac

SEQ ID NO: 299163 - DNA, 1858 bp, Homo sapiens
actgttttccatagttgctatactaatttagaagaaaggaacaagttccaatgtttgatagcagagtaagatacctatagttaacaacgttttgcatatttcaaaatagctagaagaaaaaaacttaaaatgttccccacatatagaaatgatgaatattcaaggtgatgtatgccttaagtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacactttaaaaaatacacatagcagagtatcggaaagtatgtaccaaaacattgatctggctaccactgggagtcaggatcatgagttcatcttcttccttcttactgcttttccaaacattctccagtaagcaggtactacatttataatggaaggaattttttaaaaaattttaagctgtacactttcaagtaagatctgaattctaatgctggcttgtgcctcttactatgtggtttggtcattatagataatgcccagtttcagtttccccatctttgaaaaggagataatatgttatctcttgggagtagttctgaatatgaagtgtgttgatacaagaagcactgacaatgtttctgtttcttaaatttaaaactggcctggtttgccttttttatcaagagagcttaacagataaaaaatgaaattagtctattttctacttgccagcagagtatctgtcttattttaggatgcagtgtgaaacttaccattcaactgaacaactagttgtcaactaatgaaaataaaacattttctctaagcatctttagcctcatttcac

SEQ ID NO: 299164 - DNA, 1667 bp, Homo sapiens
  misc_feature (26)..(26): n is a, c, g, or t
ggacgactctagagttaccccacgtngacacttcgggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacactttaaaaaatacacatagcagagtatcggaaagtatgtaccaaaacattgatctggctaccactgggagtcaggatcatgagttcatcttcttccttcttactgcttttccaaacattctccagtaagcaggtactacatttataatggaaggaattttttaaaaaattttaagctgtacactttcaagtaagatctgaattctaatgctggcttgtgcctcttactatgtggtttggtcattatagataatgcccagtttcagtttccccatctttgaaaaggagataatatgttatctcttgggagtagttctgaatatgaagtgtgttgatacaagaagcactgacaatgtttctgtttcttaaatttaaaactggcctggtttgccttttttatcaagagagcttaacagataaaaaatgaaattagtctattttctacttgccagcagagtatctgtcttattttaggatgcagtgtgaaacttaccattcaactgaacaactagttgtcaactaatgaaaataaaacattttctctaagcatctttagcctcatttcac

SEQ ID NO: 299165 - DNA, 2006 bp, Homo sapiens
agcggggagaggcctggcgcacagggcgagggcggctgcggcgcagtctgcagcatggcgtacccggggcatcctggcgccggcggcgggtactacccaggcgggtatggaggggctcccggagggcctgcgtttcccggacaaactcaggatccgctgtatggttactttgctgctgtagctggacaggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatactgctcagcaagttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacactttaaaaaatacacatagcagagtatcggaaagtatgtaccaaaacattgatctggctaccactgggagtcaggatcatgagttcatcttcttccttcttactgcttttccaaacattctccagtaagcaggtactacatttataatggaaggaattttttaaaaaattttaagctgtacactttcaagtaagatctgaattctaatgctggcttgtgcctcttactatgtggtttggtcattatagataatgcccagtttcagtttccccatctttgaaaaggagataatatgttatctcttgggagtagttctgaatatgaagtgtgttgatacaagaagcactgacaatgtttctgtttcttaaatttaaaactggcctggtttgccttttttatcaagagagcttaacagataaaaaatgaaattagtctattttctacttgccagcagagtatctgtcttattttaggatgcagtgtgaaacttaccattcaactgaacaactagttgtcaactaatgaaaataaaacattttctctaagcatctttagcctcatttcac

SEQ ID NO: 299166 - DNA, 2139 bp, Homo sapiens
taacattgattcctctgcaagtgatgggatttttcacatcccacttgttggactgagtttaggtagtgctgactatccagtgcattccatcccacctcatttgtctgggggcactaaacaagggaatattagtaccagagatgatgctaggacagaagggcaaacagcatagcctgaagcacccacaaagtacagcctagttccagtaacaagaccgctttttataagtggttcacaatggcaacgctatttccttataatcaagtcatgtaagttatcttttccccacagtaaaaattggcacttgagctttttctccatagcccctttctatttttaaatcattaattttacatcataccaagaataatctacaataacttttttagccattgaatattgaattccccttatccttgatctttcatttaatccttagaaaatatcgcaaaatacagctctaatccttgattacagttcagagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacacagctttcgaagacgggatactgctcagcaaggtgttgtgaatttcccatatgatgatttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacactttaaaaaatacacatagcagagtatcggaaagtatgtaccaaaacattgatctggctaccactgggagtcaggatcatgagttcatcttcttccttcttactgcttttccaaacattctccagtaagcaggtactacatttataatggaaggaattttttaaaaaattttaagctgtacactttcaagtaagatctgaattctaatgctggcttgtgcctcttactatgtggtttggtcattatagataatgcccagtttcagtttccccatctttgaaaaggagataatatgttatctcttgggagtagttctgaatatgaagtgtgttgatacaagaagcactgacaatgtttctgtttcttaaatttaaaactggcctggtttgccttttttatcaagagagcttaacagataaaaaatgaaattagtctattttctacttgccagcagagtatctgtcttattttaggatgcagtgtgaaacttaccattcaactgaacaactagttgtcaactaatgaaaataaaacattttctctaagcatctttagcctcatttcac

SEQ ID NO: 299167 - DNA, 1478 bp, Homo sapiens
agctgccagaaataggctgtgccgtataagtgctttgaggtctgtcatataatgctgatttttctttcagttcattcaatgtgtcatgagtgtttaaatcaagaggaagctgcatgaatgtaatcaacattccaactggagctctcctttgcttgtcctctttgccttcggtaatatgtataaacttacatcacgactttctcttaacagctgttgtaaagtttattactttatgtacaactgaagttttgttttagttttgataataaattctttggaactttaataagatctagtctgttacaccatttagaactttcctgagccattatcagtcatgccttattttcttgctaaaactctatgtaaatttaagtatgcaaaatgtttaagtcacattatttatttttcattgtgagacactaaaaactgttaatcagactacagctgttatctttcctctcctacaaagaatactccacacataaaaacttaggtaaatgacatagacgcacttgggtgaaataaaacaacaaaaaaggtaatccagtaatccacgtcaggattcaccttagaagtttagcacacgcccttcaaaacctgttgaataatttgattggcaaatactatctgtcaccaagtccctttttgtcatctatttaaacctttgttaactctccttaaaaatcttgtacattataagcttaactatataaaaagaaaattgatagaaaaagactaagggaatatatggaaatattaacaatgtttattttggatgaatggaattctagatgactttaattttctttatatcagtatttttcagattttctatatgctttccttttaaaatcagattttagtttttaaaatactgatacatccattttgatataccatgtattcacactttaaaaaatacacatagcagagtatcggaaagtatgtaccaaaacattgatctggctaccactgggagtcaggatcatgagttcatcttcttccttcttactgcttttccaaacattctccagtaagcaggtactacatttataatggaaggaattttttaaaaaattttaagctgtacactttcaagtaagatctgaattctaatgctggcttgtgcctcttactatgtggtttggtcattatagataatgcccagtttcagtttccccatctttgaaaaggagataatatgttatctcttgggagtagttctgaatatgaagtgtgttgatacaagaagcactgacaatgtttctgtttcttaaatttaaaactggcctggtttgccttttttatcaagagagcttaacagataaaaaatgaaattagtctattttctacttgccagcagagtatctgtcttattttaggatgcagtgtgaaacttaccattcaactgaacaactagttgtcaactaatgaaaataaaacattttctctaagcatctttagcctcatttcac

SEQ ID NO: 299168 - DNA, 896 bp, Homo sapiens
agcggggagaggcctggcgcacagggcgagggcggctgcggcgcagtctgcagcatggcgtacccggggcatcctggcgccggcggcgggtactacccaggcgggtatggaggggctcccggagggcctgcgtttcccggacaaactcaggatccgctgtatggttactttgctgctgtagctggacaggatgggcagatagatgctgatgaattgcagagatgtctgacacagtctggcattgctggaggatacaaaccttttaacctggagacttgccggcttatggtttcaatgctggatagagatatgtctggcacaatgggtttcaatgaatttaaagaactctgggctgtactgaatggctggagacaacactttatcagttttgacactgacaggagtggaacagtagacccacaagaattgcagaaggccctgacaacaatgggatttaggttgagtccccaggctgtgaattcaattgcaaaacgatacagcaccaatggaaagatcaccttcgacgactacatcgcctgctgcgtcaaactgagggctcttacagacagctttcgaagacgggatacttcggggcgcgcggagctggggggtccctgtggggctcccggagttaagatggcgtcctcagcggagggggacgaggggactgtggtggcgctggcgggggttctgcagtcgggtttccaggagctgagccttaacgggttggcgacgtccctgggcgcgtcagaacaggcgctgcggctgatcatctccatcttcctgggttacccctttgctttggtttatcggcattaccttttctacaaggagacctacctcatccacctcttccatacctttacaggcctctcaattgcttattttaactttgg

SEQ ID NO: 299169 - DNA, 4290 bp, Homo sapiens
  misc_feature (15)..(15): n is a, c, g, or t
gctcggccgccagtnggaagcgccagcccagagcctgggaagtggccgcagaggctgctcggccccgctgcccgccaggtcgtgggctcccgctccgggcccggggccaccggctgtggacttcaaaatgagcgtccctgactacatgcagtgtgctgaggaccaccagacgctgctcgtggtggtccagcctgtgggcatcgtctccgaggagaacttcttcaggatctataagaggatttgctctgtgagtcagatcagcgtgcgggactcccagcgagtcctctacatccgctacaggcaccactacccacccgagaacaacgagtggggtgacttccagacccaccgcaaagtcgtgggcctcatcaccatcacagactgcttctcggccaaggactggccacagacctttgagaagttccacgtgcagaaggagatctacggctccacactgtatgactcccggctctttgtcttcgggctgcagggggagatcgtggagcagccgcgcaccgacgtggctttctaccccaactacgaggactgccagacggtggagaagagaatcgaggacttcatcgagtcactgttcatcgtgctggagtccaagcgtctggacagagccacagacaagtctggggataagatcccccttctctgtgtcccgtttgagaaaaaggactttgtaggactggacacagacagcagacattacaagaagcggtgccaaggccgcatgcggaagcacgtgggggacctgtgcctgcaggcagggatgctgcaggactccctggtgcattaccacatgtcggtggagctgctgcgttctgtgaatgactttctgtggcttggagctgccctggaaggattgtgttcagcttctgtcatctatcactatcctggtggaactggtgggaagagtggagctcggaggttccagggcagcacccttcctgctgaagcagccaatagacaccggccaggggcacaggaagttctcattgatccaggtgccctcaccaccaatggcatcaaccctgacaccagtactgagatcggacgtgctaagaactgccttagccctgaagacataattgacaagtataaagaggcgatttcctattacagcaagtataagaatgcgggagtgattgagttggaagcgtgcatcaaggctgtacgtgtccttgcaattcagaaacggagcatggaagcatcagaatttcttcagaatgcagtttacattaaccttcgacagctttctgaggaagagaaaattcagcgctacagcatcctctccgagctctatgagctgatcggcttccatcgcaagtctgcgttcttcaagcgcgtggccgccatgcagtgcgtggccccaagcatcgcggagcctgggtggagggcctgctacaaactcctcctggaaacgctgcccggctacagtctgtcgctggatcccaaagatttcagcagaggcacgcacagaggctgggctgcggtccagatgcgtttgctccatgaattggtctacgcctcccgaaggatggggaaccctgccctctctgtcagacacctgtccttccttctacagaccatgctggacttcttgtcggatcaggaaaagaaagatgtggcccaaagcctagagaactatacgtccaagtgtcctgggaccatggagcccatcgccctccctggcggcctcaccctgccaccggtgcccttcaccaagcttcccatcgtcaggcatgtgaaactattgaaccttcctgctagcctccggccacacaaaatgaaaagcttgctgggtcagaacgtgtcaaccaaaagtcctttcatctattcaccaattatcgcacacaaccgtggagaagagcggaacaagaaaatagatttccagtgggttcaaggagatgtgtgtgaagttcagctgatggtatataacccaatgccgtttgaacttcgagttgaaaacatggggctgctcaccagcggagtggagttcgagtctctccctgcggcgctttctcttccggctgaatctggtctgtacccagtgacgctcgtcggggtcccgcagacgactggaacgattactgtgaacggttaccataccacggtcttcggtgtgttcagtgactgtttgctggataacctgccgggaataaaaaccagtggctccacagtggaagtcattcccgcgttgccaagactgcagatcagcacctctctgcccagatctgcacattcattgcaaccttcttctggtgatgaaatatctactaatgtatctgtccagctttacaatggagaaagtcagcaactaatcattaaattggaaaatattggaatggaaccattggagaaactggaggtcacctcgaaagttctcaccactaaagaaaaattgtatggcgacttcttgagctggaagctagaggaaacccttgcccagttccctttgcagcctgggaaggtggccacgttcacaatcaacatcaaagtgaagctggatttctcctgccaggagaatctcctgcaggatctcagtgatgatggaatcagtgtgagtggctttcccctgtccagtccttttcggcaggtcgttcggccccgagtggagggcaaacctgtgaacccacccgagagcaacaaagcaggcgactacagccacgtgaagaccctggaagctgtcctgaatttcaaatactctggaggcccgggccacactgaaggatattacaggaatctctccctggggctgcatgtagaagtcgagccgtctgtatttttcacccgagtcagcaccctcccagcaaccagtacccggcagtgtcacctgctcctggatgtcttcaactccaccgagcatgagctgaccgtcagcaccaggagcagcgaggcactcatcctgcacgccggcgagtgccagcgaatggctattcaagtggacaagttcaactttgagagtttcccggagtcccctggggagaaggggcaatttgcaaaccccaagcagctggaggaagagcggcgggaagcccgaggcctggagatccacagcaagctgggcatctgctggagaatcccctccctgaagcgcagtggcgaggcgagtgtggaaggactcctgaaccagctcgtcctggagcacctgcagctggcgcctctgcagtgggatgtgctggtggacggacagccatgtgaccgcgaggctgtggcggcctgccaggtgggcgaccccgtgcgcctggaggtgcggctgaccaaccggagcccgcgcagcgtagggcccttcgccctcactgtggtccccttccaggaccaccagaacggcgtgcacaactacgacctgcacgacaccgtctccttcgtgggctccagcaccttctacctcgacgcggtgcagccgtccggccagtcggcctgcctcggggccctcctcttcctctacacgggagacttcttcctccacatccggttccacgaggacagcaccagcaaggagctgccaccctcttggttctgcctgcccagtgtgcacgtgtgtgccctggaggcgcaggcctgagcccgcctacttccgtccctctttctgcagggccagaggtgaccctgcctggcctcccacaccccctgcaatgagcaaggccttcactgcagccccatctcctcctcctcccccagacccctcccagccctctcctcctgttcctcctgtagcatctttgctgggctacgcagaagccccggacatggcagccccaccccatgccacgccccttcctacactgttccctggaccatacacaggctgaagcagaggaaatcccaaagcgggtgcccatccagcccaggtcccaggatccctgcacccatttctgtgacctggggccccagccgtgctgtgctgctcatcccagcagagggacctccctcgtccagcgacttccctttggccatagaaagaaatggtgagcatgagactgggcacagcctgagggcgtgggcagcttcccaccctccctgggccttggaatcccccaaggctggttttcttcctggagacccccatgggcaacttggcaggagagatggtgccgtaggaggtcgtggatggttgatgccaagagaggccctccacccgtggtgggcaaatgtccaggcctgggctggcagcccagggctgtttctgggtgctccctggccccagggtggcgtctggttaccatggctgtgtgtgtccatgtctgcaagcagttcttcaataaatggcctgcctccccc

SEQ ID NO: 299170 - DNA, 4263 bp, Homo sapiens
  misc_feature (15)..(15): n is a, c, g, or t
gctcggccgccagtnggaagcgccagcccagagcctgggaagtggccgcagaggctgctcggccccgctgcccgccaggtcgtgggctcccgctccgggcccggggccaccggctgtggacttcaaaatgagcgtccctgactacatgcagtgtgctgaggaccaccagacgctgctcgtggtggtccagcctgtgggcatcgtctccgaggagaacttcttcaggatctataagaggatttgctctgtgagtcagatcagcgtgcgggactcccagcgagtcctctacatccgctacaggcaccactacccacccgagaacaacgagtggggtgacttccagacccaccgcaaagtcgtgggcctcatcaccatcacagactgcttctcggccaaggactggccacagacctttgagaagttccacgtgcagaaggagatctacggctccacactgtatgactcccggctctttgtcttcgggctgcagggggagatcgtggagcagccgcgcaccgacgtggctttctaccccaactacgaggactgccagacggtggagaagagaatcgaggacttcatcgagtcactgttcatcgtgctggagtccaagcgtctggacagagccacagacaagtctggggataagatcccccttctctgtgtcccgtttgagaaaaaggactttgtaggactggacacagacagcagacattacaagaagcggtgccaaggccgcatgcggaagcacgtgggggacctgtgcctgcaggcagggatgctgcaggactccctggtgcattaccacatgtcggtggagctgctgcgttctgtgaatgactttctgtggcttggagctgccctggaaggattgtgttcagcttctgtcatctatcactatcctggtggaactggtgggaagagtggagctcggaggttccagggcagcacccttcctgctgaagcagccaatagacaccggccaggtgccctcaccaccaatggcatcaaccctgacaccagtactgagatcggacgtgctaagaactgccttagccctgaagacataattgacaagtataaagaggcgatttcctattacagcaagtataagaatgcgggagtgattgagttggaagcgtgcatcaaggctgtacgtgtccttgcaattcagaaacggagcatggaagcatcagaatttcttcagaatgcagtttacattaaccttcgacagctttctgaggaagagaaaattcagcgctacagcatcctctccgagctctatgagctgatcggcttccatcgcaagtctgcgttcttcaagcgcgtggccgccatgcagtgcgtggccccaagcatcgcggagcctgggtggagggcctgctacaaactcctcctggaaacgctgcccggctacagtctgtcgctggatcccaaagatttcagcagaggcacgcacagaggctgggctgcggtccagatgcgtttgctccatgaattggtctacgcctcccgaaggatggggaaccctgccctctctgtcagacacctgtccttccttctacagaccatgctggacttcttgtcggatcaggaaaagaaagatgtggcccaaagcctagagaactatacgtccaagtgtcctgggaccatggagcccatcgccctccctggcggcctcaccctgccaccggtgcccttcaccaagcttcccatcgtcaggcatgtgaaactattgaaccttcctgctagcctccggccacacaaaatgaaaagcttgctgggtcagaacgtgtcaaccaaaagtcctttcatctattcaccaattatcgcacacaaccgtggagaagagcggaacaagaaaatagatttccagtgggttcaaggagatgtgtgtgaagttcagctgatggtatataacccaatgccgtttgaacttcgagttgaaaacatggggctgctcaccagcggagtggagttcgagtctctccctgcggcgctttctcttccggctgaatctggtctgtacccagtgacgctcgtcggggtcccgcagacgactggaacgattactgtgaacggttaccataccacggtcttcggtgtgttcagtgactgtttgctggataacctgccgggaataaaaaccagtggctccacagtggaagtcattcccgcgttgccaagactgcagatcagcacctctctgcccagatctgcacattcattgcaaccttcttctggtgatgaaatatctactaatgtatctgtccagctttacaatggagaaagtcagcaactaatcattaaattggaaaatattggaatggaaccattggagaaactggaggtcacctcgaaagttctcaccactaaagaaaaattgtatggcgacttcttgagctggaagctagaggaaacccttgcccagttccctttgcagcctgggaaggtggccacgttcacaatcaacatcaaagtgaagctggatttctcctgccaggagaatctcctgcaggatctcagtgatgatggaatcagtgtgagtggctttcccctgtccagtccttttcggcaggtcgttcggccccgagtggagggcaaacctgtgaacccacccgagagcaacaaagcaggcgactacagccacgtgaagaccctggaagctgtcctgaatttcaaatactctggaggcccgggccacactgaaggatattacaggaatctctccctggggctgcatgtagaagtcgagccgtctgtatttttcacccgagtcagcaccctcccagcaaccagtacccggcagtgtcacctgctcctggatgtcttcaactccaccgagcatgagctgaccgtcagcaccaggagcagcgaggcactcatcctgcacgccggcgagtgccagcgaatggctattcaagtggacaagttcaactttgagagtttcccggagtcccctggggagaaggggcaatttgcaaaccccaagcagctggaggaagagcggcgggaagcccgaggcctggagatccacagcaagctgggcatctgctggagaatcccctccctgaagcgcagtggcgaggcgagtgtggaaggactcctgaaccagctcgtcctggagcacctgcagctggcgcctctgcagtgggatgtgctggtggacggacagccatgtgaccgcgaggctgtggcggcctgccaggtgggcgaccccgtgcgcctggaggtgcggctgaccaaccggagcccgcgcagcgtagggcccttcgccctcactgtggtccccttccaggaccaccagaacggcgtgcacaactacgacctgcacgacaccgtctccttcgtgggctccagcaccttctacctcgacgcggtgcagccgtccggccagtcggcctgcctcggggccctcctcttcctctacacgggagacttcttcctccacatccggttccacgaggacagcaccagcaaggagctgccaccctcttggttctgcctgcccagtgtgcacgtgtgtgccctggaggcgcaggcctgagcccgcctacttccgtccctctttctgcagggccagaggtgaccctgcctggcctcccacaccccctgcaatgagcaaggccttcactgcagccccatctcctcctcctcccccagacccctcccagccctctcctcctgttcctcctgtagcatctttgctgggctacgcagaagccccggacatggcagccccaccccatgccacgccccttcctacactgttccctggaccatacacaggctgaagcagaggaaatcccaaagcgggtgcccatccagcccaggtcccaggatccctgcacccatttctgtgacctggggccccagccgtgctgtgctgctcatcccagcagagggacctccctcgtccagcgacttccctttggccatagaaagaaatggtgagcatgagactgggcacagcctgagggcgtgggcagcttcccaccctccctgggccttggaatcccccaaggctggttttcttcctggagacccccatgggcaacttggcaggagagatggtgccgtaggaggtcgtggatggttgatgccaagagaggccctccacccgtggtgggcaaatgtccaggcctgggctggcagcccagggctgtttctgggtgctccctggccccagggtggcgtctggttaccatggctgtgtgtgtccatgtctgcaagcagttcttcaataaatggcctgcctccccc

SEQ ID NO: 299171 - DNA, 4252 bp, Homo sapiens
ttacgggcctcgtcgatccgggcctccgccgtatgatgcggggtcggccccgaatgtccgccatgtcgtgggctcccgctcctgggccctggggccacctggatgtggacttcaaaatgagcgtccctgactacatgcagtgtgctgaggaccaccagacgctgctcgtggtggtccagcctgtgggcatcgtctccgaggagaacttcttcaggatctataagaggatttgctctgtgagtcagatcagcgtgcgggactcccagcgagtcctctacatccgctacaggcaccactacccacccgagaacaacgagtggggtgacttccagacccaccgcaaagtcgtgggcctcatcaccatcacagactgcttctcggccaaggactggccacagacctttgagaagttccacgtgcagaaggagatctacggctccacactgtatgactcccggctctttgtcttcgggctgcagggggagatcgtggagcagccgcgcaccgacgtggctttctaccccaactacgaggactgccagacggtggagaagagaatcgaggacttcatcgagtcactgttcatcgtgctggagtccaagcgtctggacagagccacagacaagtctggggataagatcccccttctctgtgtcccgtttgagaaaaaggactttgtaggactggacacagacagcagacattacaagaagcggtgccaaggccgcatgcggaagcacgtgggggacctgtgcctgcaggcagggatgctgcaggactccctggtgcattaccacatgtcggtggagctgctgcgttctgtgaatgactttctgtggcttggagctgccctggaaggattgtgttcagcttctgtcatctatcactatcctggtggaactggtgggaagagtggagctcggaggttccagggcagcacccttcctgctgaagcagccaatagacaccggccaggtgccctcaccaccaatggcatcaaccctgacaccagtactgagatcggacgtgctaagaactgccttagccctgaagacataattgacaagtataaagaggcgatttcctattacagcaagtataagaatgcgggagtgattgagttggaagcgtgcatcaaggctgtacgtgtccttgcaattcagaaacggagcatggaagcatcagaatttcttcagaatgcagtttacattaaccttcgacagctttctgaggaagagaaaattcagcgctacagcatcctctccgagctctatgagctgatcggcttccatcgcaagtctgcgttcttcaagcgcgtggccgccatgcagtgcgtggccccaagcatcgcggagcctgggtggagggcctgctacaaactcctcctggaaacgctgcccggctacagtctgtcgctggatcccaaagatttcagcagaggcacgcacagaggctgggctgcggtccagatgcgtttgctccatgaattggtctacgcctcccgaaggatggggaaccctgccctctctgtcagacacctgtccttccttctacagaccatgctggacttcttgtcggatcaggaaaagaaagatgtggcccaaagcctagagaactatacgtccaagtgtcctgggaccatggagcccatcgccctccctggcggcctcaccctgccaccggtgcccttcaccaagcttcccatcgtcaggcatgtgaaactattgaaccttcctgctagcctccggccacacaaaatgaaaagcttgctgggtcagaacgtgtcaaccaaaagtcctttcatctattcaccaattatcgcacacaaccgtggagaagagcggaacaagaaaatagatttccagtgggttcaaggagatgtgtgtgaagttcagctgatggtatataacccaatgccgtttgaacttcgagttgaaaacatggggctgctcaccagcggagtggagttcgagtctctccctgcggcgctttctcttccggctgaatctggtctgtacccagtgacgctcgtcggggtcccgcagacgactggaacgattactgtgaacggttaccataccacggtcttcggtgtgttcagtgactgtttgctggataacctgccgggaataaaaaccagtggctccacagtggaagtcattcccgcgttgccaagactgcagatcagcacctctctgcccagatctgcacattcattgcaaccttcttctggtgatgaaatatctactaatgtatctgtccagctttacaatggagaaagtcagcaactaatcattaaattggaaaatattggaatggaaccattggagaaactggaggtcacctcgaaagttctcaccactaaagaaaaattgtatggcgacttcttgagctggaagctagaggaaacccttgcccagttccctttgcagcctgggaaggtggccacgttcacaatcaacatcaaagtgaagctggatttctcctgccaggagaatctcctgcaggatctcagtgatgatggaatcagtgtgagtggctttcccctgtccagtccttttcggcaggtcgttcggccccgagtggagggcaaacctgtgaacccacccgagagcaacaaagcaggcgactacagccacgtgaagaccctggaagctgtcctgaatttcaaatactctggaggcccgggccacactgaaggatattacaggaatctctccctggggctgcatgtagaagtcgagccgtctgtatttttcacccgagtcagcaccctcccagcaaccagtacccggcagtgtcacctgctcctggatgtcttcaactccaccgagcatgagctgaccgtcagcaccaggagcagcgaggcactcatcctgcacgccggcgagtgccagcgaatggctattcaagtggacaagttcaactttgagagtttcccggagtcccctggggagaaggggcaatttgcaaaccccaagcagctggaggaagagcggcgggaagcccgaggcctggagatccacagcaagctgggcatctgctggagaatcccctccctgaagcgcagtggcgaggcgagtgtggaaggactcctgaaccagctcgtcctggagcacctgcagctggcgcctctgcagtgggatgtgctggtggacggacagccatgtgaccgcgaggctgtggcggcctgccaggtgggcgaccccgtgcgcctggaggtgcggctgaccaaccggagcccgcgcagcgtagggcccttcgccctcactgtggtccccttccaggaccaccagaacggcgtgcacaactacgacctgcacgacaccgtctccttcgtgggctccagcaccttctacctcgacgcggtgcagccgtccggccagtcggcctgcctcggggccctcctcttcctctacacgggagacttcttcctccacatccggttccacgaggacagcaccagcaaggagctgccaccctcttggttctgcctgcccagtgtgcacgtgtgtgccctggaggcgcaggcctgagcccgcctacttccgtccctctttctgcagggccagaggtgaccctgcctggcctcccacaccccctgcaatgagcaaggccttcactgcagccccatctcctcctcctcccccagacccctcccagccctctcctcctgttcctcctgtagcatctttgctgggctacgcagaagccccggacatggcagccccaccccatgccacgccccttcctacactgttccctggaccatacacaggctgaagcagaggaaatcccaaagcgggtgcccatccagcccaggtcccaggatccctgcacccatttctgtgacctggggccccagccgtgctgtgctgctcatcccagcagagggacctccctcgtccagcgacttccctttggccatagaaagaaatggtgagcatgagactgggcacagcctgagggcgtgggcagcttcccaccctccctgggccttggaatcccccaaggctggttttcttcctggagacccccatgggcaacttggcaggagagatggtgccgtaggaggtcgtggatggttgatgccaagagaggccctccacccgtggtgggcaaatgtccaggcctgggctggcagcccagggctgtttctgggtgctccctggccccagggtggcgtctggttaccatggctgtgtgtgtccatgtctgcaagcagttcttcaataaatggcctgcctccccc

SEQ ID NO: 299172 - DNA, 1677 bp, Homo sapiens
tgatttggttcccaggcttgctttgaagacatgctgtgtgctagagaaggctgggcctgaggagttggagaccctggaagctgtcctgaatttcaaatactctggaggcccgggccacactgaaggatattacaggaatctctccctggggctgcatgtagaagtcgagccgtctgtatttttcacccgagtcagcaccctcccagcaaccagtacccggcagtgtcacctgctcctggatgtcttcaactccaccgagcatgagctgaccgtcagcaccaggagcagcgaggcactcatcctgcacgccggcgagtgccagcgaatggctattcaagtggacaagttcaactttgagagtttcccggagtcccctggggagaaggggcaatttgcaaaccccaagcagctggaggaagagcggcgggaagcccgaggcctggagatccacagcaagctgggcatctgctggagaatcccctccctgaagcgcagtggcgaggcgagtgtggaaggactcctgaaccagctcgtcctggagcacctgcagctggcgcctctgcagtgggatgtgctggtggacggacagccatgtgaccgcgaggctgtggcggcctgccaggtgggcgaccccgtgcgcctggaggtgcggctgaccaaccggagcccgcgcagcgtagggcccttcgccctcactgtggtccccttccaggaccaccagaacggcgtgcacaactacgacctgcacgacaccgtctccttcgtgggctccagcaccttctacctcgacgcggtgcagccgtccggccagtcggcctgcctcggggccctcctcttcctctacacgggagacttcttcctccacatccggttccacgaggacagcaccagcaaggagctgccaccctcttggttctgcctgcccagtgtgcacgtgtgtgccctggaggcgcaggcctgagcccgcctacttccgtccctctttctgcagggccagaggtgaccctgcctggcctcccacaccccctgcaatgagcaaggccttcactgcagccccatctcctcctcctcccccagacccctcccagccctctcctcctgttcctcctgtagcatctttgctgggctacgcagaagccccggacatggcagccccaccccatgccacgccccttcctacactgttccctggaccatacacaggctgaagcagaggaaatcccaaagcgggtgcccatccagcccaggtcccaggatccctgcacccatttctgtgacctggggccccagccgtgctgtgctgctcatcccagcagagggacctccctcgtccagcgacttccctttggccatagaaagaaatggtgagcatgagactgggcacagcctgagggcgtgggcagcttcccaccctccctgggccttggaatcccccaaggctggttttcttcctggagacccccatgggcaacttggcaggagagatggtgccgtaggaggtcgtggatggttgatgccaagagaggccctccacccgtggtgggcaaatgtccaggcctgggctggcagcccagggctgtttctgggtgctccctggccccagggtggcgtctggttaccatggctgtgtgtgtccatgtctgcaagcagttcttcaataaatggcctgcctccccc

SEQ ID NO: 299173 - DNA, 1345 bp, Homo sapiens
  misc_feature (25)..(25): n is a, c, g, or t
agcaggcggtaccgtccgggagtanggatgtgaaaatgaggttcaacttgtcttaatatattctatcaggcaaaagaaacaaattccccagggaggggtagtccagctgctgccactcctggagtgagcctgtggacagtctctccagccagaggccaccagaggaacctcgggagggcaggaggctccttctgcagcaccacgtcgtttcttccccaggcttgctttttctgtttgatgtgctggtggacggacagccatgtgaccgcgaggctgtggcggcctgccaggtgggcgaccccgtgcgcctggaggtgcggctgaccaaccggagcccgcgcagcgtagggcccttcgccctcactgtggtccccttccaggaccaccagaacggcgtgcacaactacgacctgcacgacaccgtctccttcgtgggctccagcaccttctacctcgacgcggtgcagccgtccggccagtcggcctgcctcggggccctcctcttcctctacacgggagacttcttcctccacatccggttccacgaggacagcaccagcaaggagctgccaccctcttggttctgcctgcccagtgtgcacgtgtgtgccctggaggcgcaggcctgagcccgcctacttccgtccctctttctgcagggccagaggtgaccctgcctggcctcccacaccccctgcaatgagcaaggccttcactgcagccccatctcctcctcctcccccagacccctcccagccctctcctcctgttcctcctgtagcatctttgctgggctacgcagaagccccggacatggcagccccaccccatgccacgccccttcctacactgttccctggaccatacacaggctgaagcagaggaaatcccaaagcgggtgcccatccagcccaggtcccaggatccctgcacccatttctgtgacctggggccccagccgtgctgtgctgctcatcccagcagagggacctccctcgtccagcgacttccctttggccatagaaagaaatggtgagcatgagactgggcacagcctgagggcgtgggcagcttcccaccctccctgggccttggaatcccccaaggctggttttcttcctggagacccccatgggcaacttggcaggagagatggtgccgtaggaggtcgtggatggttgatgccaagagaggccctccacccgtggtgggcaaatgtccaggcctgggctggcagcccagggctgtttctgggtgctccctggccccagggtggcgtctggttaccatggctgtgtgtgtccatgtctgcaagcagttcttcaataaatggcctgcctccccc

SEQ ID NO: 299174 - DNA, 1795 bp, Homo sapiens
  misc_feature (15)..(15): n is a, c, g, or t
gctcggccgccagtnggaagcgccagcccagagcctgggaagtggccgcagaggctgctcggccccgctgcccgccaggtcgtgggctcccgctccgggcccggggccaccggctgtggacttcaaaatgagcgtccctgactacatgcagtgtgctgaggaccaccagacgctgctcgtggtggtccagcctgtgggcatcgtctccgaggagaacttcttcaggatctataagaggatttgctctgtgagtcagatcagcgtgcgggactcccagcgagtcctctacatccgctacaggcaccactacccacccgagaacaacgagtggggtgacttccagacccaccgcaaagtcgtgggcctcatcaccatcacagactgcttctcggccaaggactggccacagacctttgagaagttccacgtgcagaaggagatctacggctccacactgtatgactcccggctctttgtcttcgggctgcagggggagatcgtggagcagccgcgcaccgacgtggctttctaccccaactacgaggactgccagacggtggagaagagaatcgaggacttcatcgagtcactgttcatcgtgctggagtccaagcgtctggacagagccacagacaagtctggggataagatcccccttctctgtgtcccgtttgagaaaaaggactttgtaggactggacacagacagcagacattacaagaagcggtgccaaggccgcatgcggaagcacgtgggggacctgtgcctgcaggcagggatgctgcaggactccctggtgcattaccacatgtcggtggagctgctgcgttctgtgaatgactttctgtggcttggagctgccctggaaggattgtgttcagcttctgtcatctatcactatcctggtggaactggtgggaagagtggagctcggaggttccagggcagcacccttcctgctgaagcagccaatagacaccggccaggggcacaggaagttctcattgatccaggtgccctcaccaccaatggcatcaaccctgacaccagtactgagatcggacgtgctaagaactgccttagccctgaagacataattgacaagtataaagaggcgatttcctattacagcaagtataagaatgcgggagtgattgagttggaagcgtgcatcaaggctgtacgtgtccttgcaattcagaaacggagcatggaagcatcagaatttcttcagaatgcagtttacattaaccttcgacagctttctgaggaagagaaaattcagcgctacagcatcctctccgagctctatgagctgatcggcttccatcgcaagtctgcgttcttcaagcgcgtggccgccatgcagtgcgtggccccaagcatcgcggagcctgggtggagggcctgctacaaactcctcctggaaacgctgcccggctacagtctgtcgctggatcccaaagatttcagcagaggcacgcacagaggctgggctgcggtccagatgcgtttgctccatgaattggtctacgcctcccgaaggatggggaaccctgccctctctgtcagacacctgtccttccttctacagaccatgctggacttcttgtcggatcaggaaaagaaagatgtggcccaaagcctagagaactatacgtccaaatgtccaggcctgggctggcagcccagggctgtttctgggtgctccctggccccagggtggcgtctggttaccatggctgtgtgtgtccatgtctgcaagcagttcttcaataaatggcctgcctccccc

SEQ ID NO: 299175 - DNA, 430 bp, Homo sapiens
gcatagagagatggttagcagttggtaggccagctctttttttcataactaaagaaaggtagccttgcctttgttagggtggtggtttgagacgcagcacttcagccatctgaggacagtcatcagatgtgggtgagtgacttcatcatgagaccagagcaggtctatttgctagtttggaggacataattcccgcttcagcaggttgttaggcagctcaggtggtataaagggtggataggagatggggcgcttaccacatgtgatgctctgtaaatgagtgctgagcaaaccaattggcagtcagatctatttttgttaaattattaaggtttgaacagaaaatacatctggatctaaaggaattcggattccctaaaaagactagtgaaaatgaggttcaacttgtcttaatatattctatcaggca

SEQ ID NO: 299176 - DNA, 501 bp, Homo sapiens
gctgcccggctacagtctgtcgctggatcccaaagatttcagcagaggtactggagtccccttgctggcgctaaggtgttgctttctgtctgatggtcacatgctgtttcagcccctgccctgagtggcagacatcgtggttggtgctggtggctccagaatgactagatccctgccctggagttgggtgcctgctgtaatccgattataggaaaaagtactggtgctttgccttggggctcggattcttgaatctttatcagtgggagtcagaaattgcctttgagttcattggcatggtgtgtcatcatcaatcaaacagtggaagtacctaatgaattttactcatgagatttagttagtttagcacaaatcaatgaacccagaataaatatccttgggtatatgtgtatacctgagctatgcattcagcagtaaattcttattctgaaatattaatgcagggtaatatgtattaaaaataaagctatcaatctaata

SEQ ID NO: 299177 - DNA, 446 bp, Homo sapiens
agctgtttgagaggctgaacccatgaggtcgaggctgcacccatgaggtcgaggctgcagtgagctatggtcatgccagtgcactccagcctgggtgacagagtgagaccctgtctcaaaaaaggaaacaaatcacccataaatggataattaagatttggttattatagacacttaatacttaggtagctaaggtagttttaccaataaattatattaatttaatatttcagtattggcaaaactgatgcatactcatttacaattttgacatggaatggttctgttttgttttattaaatttgaacttaaaagttctctgcaagaagagatttgtataataaattccctgagcctctcaaattaatattttagccatagactcatatttagagcagtgtttctaatgtaatgatacaaggcccagggttattcatagtttcacc

SEQ ID NO: 299178 - DNA, 339 bp, Homo sapiens
gcatctggtcctgaggggttagggacatcccctaagggtataccctggctttgccacccatgaaccagctcagcatacagccagtgagtgggcacccaatgcctctcaggatgagaccagtaaatgtcgcaggtgaagttggccagctgtggagccacaggccacaggccagtctagcttggctcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaa

SEQ ID NO: 299179 - DNA, 438 bp, Homo sapiens
actctttcttcctctcctcccctctccaaagttgagcgtcgcaggcgattcaacattaacgacaggatcaaggaactgggcactctcatccctaagtccagtgacccgtgagtctgggctgggaccctcaggccagcgggaggtggggcaggcgtcccatgctactaaaattgtgccttggtgggctcaccaggcagtctcggcccaggcatttctcctctgtctggttctttctcagcctgagcagggttgcagaccctcactatgtcagcacctaaaattttaggcacataatgttatggtctgtgtgccccatctggtccccgtaggatatatgcacctacttttctgttcacttagtacttcctttttttttttcttttttttgagatggagcctgggtgacagagcgagactccatcccccaccgccccgcaa

SEQ ID NO: 299180 - DNA, 3420 bp, Homo sapiens
gggaggagggggaagaagacgagggggaggagggcggtcgtccggggttaggttgagggggggcgtcggtccgttctgggcgggggatgactcacagcccatcccatctccccgacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaa

SEQ ID NO: 299181 - DNA, 3550 bp, Homo sapiens
  misc_feature (3434)..(3434): n is a, c, g, or t
  misc_feature (3438)..(3438): n is a, c, g, or t
  misc_feature (3441)..(3441): n is a, c, g, or t
gggaggagggggaagaagacgagggggaggagggcggtcgtccggggttaggttgagggggggcgtcggtccgttctgggcgggggatgactcacagcccatcccatctccccgacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaaaaaaaaaaacaaanacanaanacaaacaagagaagacaaacacacaaacaaaacacaaagggggggggcaaaaactcccgggcgacaaacacacccttgagaaaggccaaagggaaaaaaacgagggcac

SEQ ID NO: 299182 - DNA, 3354 bp, Homo sapiens
tatttcattcacgggccgggcagtatagttgacgttacatggcccttggtccaacaattgcacgtcggtccgttctgggcgggggatgactcacagcccatcccatctccccgacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaa

SEQ ID NO: 299183 - DNA, 3419 bp, Homo sapiens
tatttcattcacgggccgggcagtatagttgacgttacatggcccttggtccaacaattgcacgtcggtccgttctgggcgggggatgactcacagcccatcccatctccccgacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaa

SEQ ID NO: 299184 - DNA, 3291 bp, Homo sapiens
ccaccggcaggttgtactccaccggcaggttgtactccaccggcaggttgtactccaccggcaggttgtactccaccggcaggttgtactcatggtggtgtggtacccagcaaggtggccaaatatgaggggcttgtaccctcctcttcgttctcccccgctctctgtctctttctctgtctcaggggagggctggggaataaggtccttcattcaatcactgaccaccactccacctccccctcagcctgaactctttgcttccggaatccgggattgttgctgacatagaattagaaaacgtccttgatcctgacagcttctacgagctcaaaagccaacccttaccccttcgctcaagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaa

SEQ ID NO: 299185 - DNA, 3400 bp, Homo sapiens
tatttcattcacgggccgggcagtatagttgacgttacatggcccttggtccaacaattgcacgtcggtccgttctgggcgggggatgactcacagcccatcccatctccccgacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaa

SEQ ID NO: 299186 - DNA, 3380 bp, Homo sapiens
gggaggagggggaagaagacgagggggaggagggcggtcgtccggggttaggttgagggggggcgtcggtccgttctgggcgggggatgactcacagcccatcccatctccccgacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaa

SEQ ID NO: 299187 - DNA, 2413 bp, Homo sapiens
cgggatccccagcaggagcaggagcgggagcggattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaa

SEQ ID NO: 299188 - DNA, 2308 bp, Homo sapiens
cgggatccccagcaggagcaggagcgggagcggctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaa

SEQ ID NO: 299189 - DNA, 2547 bp, Homo sapiens
gttatgagaagaataaagactggaaggaaaatgggagaatgttggggagggttagtttgggataaggaaggtgaggacagggcaggccccaactgacaaggaaacgtttgaataaagagcctaaggaggcaaggcggggagccgcatgggtgtctgggggtaagagtattcaaggcagagggcacggctgggattgatgccctgagatgggagtggttttccatattctaggagcactgagagaccaatgtggctgtagtgagatcaatcggagggacatagggaagagaggaatcctaaggggtcaggtcagagacggcttccagggtttggagtgtgatggggcaccattgtaagattccaggcgggaagttttcctctggatactccatacctttgaaagaccccagcctcaagttctaagcatgtggtgggaggctcccacctggtgcaatccccgcctcagctcctgagaaactcctcatgtggcatttcctgcttgcctcccacttgggccccacagggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaa

SEQ ID NO: 299190 - DNA, 1391 bp, Homo sapiens
aattcagtgacggggcggtgtctcacccgatagattacgtggcccatcggtccgacaattgccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaa

SEQ ID NO: 299191 - DNA, 955 bp, Homo sapiens
  misc_feature (15)..(15): n is a, c, g, or t
  misc_feature (21)..(21): n is a, c, g, or t
ccagctggtacgccngagtantggatatgtgaccgcgcctcgccacgcgtcgccacgcgtcgggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaa

SEQ ID NO: 299192 - DNA, 2740 bp, Homo sapiens
gggaggagggggaagaagacgagggggaggagggcggtcgtccggggttaggttgagggggggcgtcggtccgttctgggcgggggatgactcacagcccatcccatctccccgacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggttaaggcaggggagcttaagtaccactcctccctgcagtgtggaatgcttagatgggatgttgctgagg

SEQ ID NO: 299193 - DNA, 2597 bp, Homo sapiens
gggaggagggggaagaagacgagggggaggagggcggtcgtccggggttaggttgagggggggcgtcggtccgttctgggcgggggatgactcacagcccatcccatctccccgacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttggcaaa

SEQ ID NO: 299194 - DNA, 1849 bp, Homo sapiens
gggaggagggggaagaagacgagggggaggagggcggtcgtccggggttaggttgagggggggcgtcggtccgttctgggcgggggatgactcacagcccatcccatctccccgacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagctcgcccctgagttagcagctcgcccctgagttagcagctcgcccctgagttagctgctcgcccctgagttagcagctcgcccctgagttagcagctcgcccctgagttagcaggt

SEQ ID NO: 299195 - DNA, 1727 bp, Homo sapiens
gggaggagggggaagaagacgagggggaggagggcggtcgtccggggttaggttgagggggggcgtcggtccgttctgggcgggggatgactcacagcccatcccatctccccgacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccgtgagtctgggctgggaccctcaggccagcgggaggtggggcaggcgtcccatgctactaaaattgtgccttggtgggctcaccaggcagtctcggcccaggcatttctcctctgtctggttctttctcagcctgagcagggttgcagaccctcactatgtcagcacctaaaattttaggcacataatgttatggtctgtgtgccccatctggtccccgtaggatatatgcacctacttttctgttcacttagtacttcctttttttttttcttttttttgagatggagcctgggtgacagagcgagactccatcccccaccgccccgcaa

SEQ ID NO: 299196 - DNA, 1819 bp, Homo sapiens
gggaggagggggaagaagacgagggggaggagggcggtcgtccggggttaggttgagggggggcgtcggtccgttctgggcgggggatgactcacagcccatcccatctccccgacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacggctggagcgcaatggtgctatctcggctcactggaacctccgcctaccaagttcaagcgattctcttgcctcagcctcctgagtaactgggactacagctgcctgtgtcagggaatctgcttgatgtgtacagtagtcaaggcgtggccacaccagccatcactgtcagcaactcctgcccagctgagctgcccaacatcaaacgggagatctctgaccggagcaaagcctttgcaggaccgggacacagaacgacatccaaactaattgagcgtcgcaggcgattcaacattaacgacaggatcaaggaactgggcactctcatccctaagtccagtgacccgtgagtctgggctgggaccctcaggccagcgggaggtggggcaggcgtcccatgctactaaaattgtgccttggtgggctcaccaggcagtctcggcccaggcatttctcctctgtctggttctttctcagcctgagcagggttgcagaccctcactatgtcagcacctaaaattttaggcacataatgttatggtctgtgtgccccatctggtccccgtaggatatatgcacctacttttctgttcacttagtacttcctttttttttttcttttttttgagatggagcctgggtgacagagcgagactccatcccccaccgccccgcaa

SEQ ID NO: 299197 - DNA, 1418 bp, Homo sapiens
gggaggagggggaagaagacgagggggaggagggcggtcgtccggggttaggttgagggggggcgtcggtccgttctgggcgggggatgactcacagcccatcccatctccccgacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacggtgaggccctgagatgggaggttggtctgaaaattagggcatttctgtatcaccaagaccatactcagtctggctgtgtgtataggagacccttgccttgattgtgctaagatagagagggaggccttatgacgagaacagggtatgtcaacaatgcctttggaccttgttggactgtgttgagaggtggaccatgtagactgtgagagatacaggtggggagttcactgagacagtagggcatatcaaagtgcttgggctttgctgtgagaa

SEQ ID NO: 299198 - DNA, 162 bp, Homo sapiens
atagaattagaaaacgtccttgatcctgacagcttctacgagctcaaaagccaacccttaccccttcgctcaaggtatgtatgacttgtctatctgattcccctcccaattcctcagccctcctctcccctcttgatgggcagaggccctcagtaccagccc

SEQ ID NO: 299199 - DNA, 1132 bp, Homo sapiens
ggcacgagggccgcccgactgccatcgcccggcccggccgcgcccgcggaaccagaccaggcagatcgggagcggtgccgagaaaaatttccttactagatgacatttcatcgcaatgtccgatcgtttggggcaaattaccaagggcaaggatgggaaaagcaagtactcgactctcagcctgtttgataagtataaaggaaaatcagtagacgcgattagatcctcagttattcctagacatggcttacagagtcttgggaaagttgctgcagcccggcgcatgccaccgcctgcaaacctgccaagcttgaagtctgaaaacaaaggaaacgaccccaacatcgtgatagtacccaaggacgggacgggatgggcaaacaagcaggatcagcaagacccaaagagttccagtgcgacggcctctcagccgccggagtcgctgccgcagccgggtttgcagaaatctgtctccaatttgcagaaaccgacacagtcaatcagtcaggagaatacaaattcagtgccaggtggaccaaagtcatgggcacagctgaatggaaagccagtaggacacgaaggtggtttaaggggctcaagccgactgttatccttctctcccgaggaatttccgacgctgaaagcagctggagggcaggacaaggctggcaaagaaaagggcgtcttagatctgtcgtatgggccaggaccaagcctccgccctcagaatgtgacaagctggagggagggcggtgggcgacacataatttctgccacgtctctgagcacctccccaactgagctgggcagcaggaactcgagtacgggagatggagccccctcctcggcatgtaccagcgattctaaggacccctctctccgcccggctcagcctgtccgaaaaggggcttcacagttcatgggaaatgtataccacccacctacataccatgacatgcttcctgcttttatgtgttcgccgaagtcatcagaaaaccagggtacagtggaacgaggctcttttccccttcctcagctccgccttgaacctcgagttccttttagacagttccagatgaatgaccaagacggaattatggtgctagattagtaaacatgacttttaatgagt

SEQ ID NO: 299200 - DNA, 448 bp, Homo sapiens
ccaccttggcctcccaaagtgctaggattacaggtgtgagccactgtgccaggcaaaagcagcatcttaatccttttggggtggactggggcagggatggcagcacactctgtaggtgttgcctccacaggaaagcagttgccttcttggcctcccctgggctgattttataggaggctgtgcttgtctgtggccccaggcagtcagtagaaccttccctgctggggcaggctgtggcctggagcggctgtgatgtcttacctctttccatttgtaagcaggcactggtccttgcaggtcagctgggaaggggcatgatgctgtcagcagcagtctcccttgccaccctcagcaccctcgtggcatctgccagcacagagcacccttgtgacaagactcccttcaaaagcccacttccaggcaacacggctttcaaggtgtggagctg

SEQ ID NO: 299201 - DNA, 1891 bp, Homo sapiens
  misc_feature (1872)..(1872): n is a, c, g, or t
ggcacgagggccgcccgactgccatcgcccggcccggccgcgcccgcggaaccagaccaggcagatcgggagcggtgccgagaaaaatttccttactagatgacatttcatcgcaatgtccgatcgtttggggcaaattaccaagggcaaggatgggaaaagcaagtactcgactctcagcctgtttgataagtataaaggaaaatcagtagacgcgattagatcctcagttattcctagacatggcttacagagtcttgggaaagttgctgcagcccggcgcatgccaccgcctgcaaacctgccaagcttgaagtctgaaaacaaaggaaacgaccccaacatcgtgatagtacccaaggacgggacgggatgggcaaacaagcaggatcagcaagacccaaagagttccagtgcgacggcctctcagccgccggagtcgctgccgcagccgggtttgcagaaatctgtctccaatttgcagaaaccgacacagtcaatcagtcaggagaatacaaattcagtgccaggtggaccaaagtcatgggcacagctgaatggaaagccagtaggacacgaaggtggtttaaggggctcaagccgactgttatccttctctcccgaggaatttccgacgctgaaagcagctggagggcaggacaaggctggcaaagaaaagggcgtcttagatctgtcgtatgggccaggaccaagcctccgccctcagaatgtgacaagctggagggagggcggtgggcgacacataatttctgccacgtctctgagcacctccccaactgagctgggcagcaggaactcgagtacgggagatggagccccctcctcggcatgtaccagcgattctaaggacccctctctccgcccggctcagcctgtccgaaaaggggcttcacagttcatgggaaatgtataccacccacctacataccatgacatgcttcctgcttttatgtgttcgccgaagtcatcagaaaaccagggtacagtggaacgaggctcttttccccttcctcagctccgccttgaacctcgagttccttttagacagttccagatgaatgaccaagacggaaaagaaaacaggctgggattgtctcgcccactccgcccactaaggcagctggtggagcgggcaccacggcccaccattatcaatgcggaaaacctgaagggccttgacgatctggacgccgatgccgatgatggctgggcaggcctccatgaagaagtggactattctgagaaactgaagttcagtgatgatgaagaggaggaagaagttgtgaaggacggcaggccaaagtggaacagttgggaccctaggaggcagcggcagttgtcaatgagctctgcagacagtgcggacgctaagcggactcgagaggaagggaaggactgggctgaagcagtgggtgcgtcccgtgtggtccgaaaggcgccagaccctcagccaccgcccaggaagcttcatggctgggcaccaggccctgactaccagaagtcatcaatgggcagcatgttccggcaacagtccatcgaggacaaggaggacaagcccccaccaaggcagaagttcattcagtcagagatgtccgaggcggtggagcgagcccgaaagcgccgggaagaagaggagcgccgagcccgggaggagaggctggccgcctgtgctgccaaactcaagcagctggaccagaagtgtaagcaggcacgaaaggcaggtgaggcccggaagcaggcagagaaggaagtgccctggtctccaagtgctgagaaggcatctccccaggaaaacggccctgctgtccacaaaggctccccagaattcctgcccaagatgcccccacctcnggacctctagacaccacca

SEQ ID NO: 299202 - DNA, 2062 bp, Homo sapiens
ggcacgagggccgcccgactgccatcgcccggcccggccgcgcccgcggaaccagaccaggcagatcgggagcggtgccgagaaaaatttccttactagatgacatttcatcgcaatgtccgatcgtttggggcaaattaccaagggcaaggatgggaaaagcaagtactcgactctcagcctgtttgataagtataaaggaaaatcagtagacgcgattagatcctcagttattcctagacatggcttacagagtcttgggaaagttgctgcagcccggcgcatgccaccgcctgcaaacctgccaagcttgaagtctgaaaacaaaggaaacgaccccaacatcgtgatagtacccaaggacgggacgggatgggcaaacaagcaggatcagcaagacccaaagagttccagtgcgacggcctctcagccgccggagtcgctgccgcagccgggtttgcagaaatctgtctccaatttgcagaaaccgacacagtcaatcagtcaggagaatacaaattcagtgccaggtggaccaaagtcatgggcacagctgaatggaaagccagtaggacacgaaggtggtttaaggggctcaagccgactgttatccttctctcccgaggaatttccgacgctgaaagcagctggagggcaggacaaggctggcaaagaaaagggcgtcttagatctgtcgtatgggccaggaccaagcctccgccctcagaatgtgacaagctggagggagggcggtgggcgacacataatttctgccacgtctctgagcacctccccaactgagctgggcagcaggaactcgagtacgggagatggagccccctcctcggcatgtaccagcgattctaaggacccctctctccgcccggctcagcctgtccgaaaaggggcttcacagttcatgggaaatgtataccacccacctacataccatgacatgcttcctgcttttatgtgttcgccgaagtcatcagaaaaccagggtacagtggaacgaggctcttttccccttcctcagctccgccttgaacctcgagttccttttagacagttccagatgaatgaccaagacggaaaagaaaacaggctgggattgtctcgcccactccgcccactaaggcagctggtggagcgggcaccacggcccaccattatcaatgcggaaaacctgaagggccttgacgatctggacgccgatgccgatgatggctgggcaggcctccatgaagaagtggactattctgagaaactgaagttcagtgatgatgaagaggaggaagaagttgtgaaggacggcaggccaaagtggaacagttgggaccctaggaggcagcggcagttgtcaatgagctctgcagacagtgcggacgctaagcggactcgagaggaagggaaggactgggctgaagcagtgggtgcgtcccgtgtggtccgaaaggcgccagaccctcagccaccgcccaggaagcttcatggctgggcaccaggccctgactaccagaagtcatcaatgggcagcatgttccggcaacagtccatcgaggacaaggaggacaagcccccaccaaggcagaagttcattcagtcagagatgtccgaggcggtggagcgagcccgaaagcgccgggaagaagaggagcgccgagcccgggaggagaggctggccgcctgtgctgccaaactcaagcagctggaccagaagtgtaagcaggcacgaaaggcaggtgaggcccggaagcaggcagagaaggaagtgccctggtctccaagtgctgagaaggcatctccccaggaaaacggccctgctgtccacaaaggctccccagaattccctgcccaagagacccccaccacattcccagaagaggcacccacagtgtccccagcagtggcacagagcaacagcagtgaggaagaggccagagaggctgggtcccctgcacaggagttcaagtatcagatcctctcccgatccagcgcacacacacacacagagcacttacaagtcacactgcacgttaccgactcgcttaagattgtagcc

SEQ ID NO: 299203 - DNA, 2092 bp, Homo sapiens
ggcacgagggccgcccgactgccatcgcccggcccggccgcgcccgcggaaccagaccaggcagatcgggagcggtgccgagaaaaatttccttactagatgacatttcatcgcaatgtccgatcgtttggggcaaattaccaagggcaaggatgggaaaagcaagtactcgactctcagcctgtttgataagtataaaggaaaatcagtagacgcgattagatcctcagttattcctagacatggcttacagagtcttgggaaagttgctgcagcccggcgcatgccaccgcctgcaaacctgccaagcttgaagtctgaaaacaaaggaaacgaccccaacatcgtgatagtacccaaggacgggacgggatgggcaaacaagcaggatcagcaagacccaaagagttccagtgcgacggcctctcagccgccggagtcgctgccgcagccgggtttgcagaaatctgtctccaatttgcagaaaccgacacagtcaatcagtcaggagaatacaaattcagtgccaggtggaccaaagtcatgggcacagctgaatggaaagccagtaggacacgaaggtggtttaaggggctcaagccgactgttatccttctctcccgaggaatttccgacgctgaaagcagctggagggcaggacaaggctggcaaagaaaagggcgtcttagatctgtcgtatgggccaggaccaagcctccgccctcagaatgtgacaagctggagggagggcggtgggcgacacataatttctgccacgtctctgagcacctccccaactgagctgggcagcaggaactcgagtacgggagatggagccccctcctcggcatgtaccagcgattctaaggacccctctctccgcccggctcagcctgtccgaaaaggggcttcacagttcatgggaaatgtataccacccacctacataccatgacatgcttcctgcttttatgtgttcgccgaagtcatcagaaaaccagggtacagtggaacgaggctcttttccccttcctcagctccgccttgaacctcgagttccttttagacagttccagatgaatgaccaagacggaaaagaaaacaggctgggattgtctcgcccactccgcccactaaggcagctggtggagcgggcaccacggcccaccattatcaatgcggaaaacctgaagggccttgacgatctggacgccgatgccgatgatggctgggcaggcctccatgaagaagtggactattctgagaaactgaagttcagtgatgatgaagaggaggaagaagttgtgaaggacggcaggccaaagtggaacagttgggaccctaggaggcagcggcagttgtcaatgagctctgcagacagtgcggacgctaagcggactcgagaggaagggaaggactgggctgaagcagtgggtgcgtcccgtgtggtccgaaaggcgccagaccctcagccaccgcccaggaagcttcatggctgggcaccaggccctgactaccagaagtcatcaatgggcagcatgttccggcaacagtccatcgaggacaaggaggacaagcccccaccaaggcagaagttcattcagtcagagatgtccgaggcggtggagcgagcccgaaagcgccgggaagaagaggagcgccgagcccgggaggagaggctggccgcctgtgctgccaaactcaagcagctggaccagaagtgtaagcaggcacgaaaggcaggtgaggcccggaagcaggcagagaaggaagtgccctggtctccaagtgctgagaaggcatctccccaggaaaacggccctgctgtccacaaaggctccccagaattccctgcccaagagacccccaccacattcccagaagaggcacccacagtgtccccagcagtggcacagagcaacagcagtgaggaagaggccagagaggctgggtcccctgcacaggagttcaagtatcagaagtcccttcctccccgattccagcgccagcagcagcaacaacagcaggagcagctgtacaagatgcagcactggcagccggtgtaccccccgccgtcccacccccagcgcacc

SEQ ID NO: 299204 - DNA, 1643 bp, Homo sapiens
ggcacgagggccgcccgactgccatcgcccggcccggccgcgcccgcggaaccagaccaggcagatcgggagcggtgccgagaaaaatttccttactagatgacatttcatcgcaatgtccgatcgtttggggcaaattaccaagggcaaggatgggaaaagcaagtactcgactctcagcctgtttgataagtataaaggaaaatcagtagacgcgattagatcctcagttattcctagacatggcttacagagtcttgggaaagttgctgcagcccggcgcatgccaccgcctgcaaacctgccaagcttgaagtctgaaaacaaaggaaacgaccccaacatcgtgatagtacccaaggacgggacgggatgggcaaacaagcaggatcagcaagacccaaagagttccagtgcgacggcctctcagccgccggagtcgctgccgcagccgggtttgcagaaatctgtctccaatttgcagaaaccgacacagtcaatcagtcaggagaatacaaattcagtgccaggtggaccaaagtcatgggcacagctgaatggaaagccagtaggacacgaaggtggtttaaggggctcaagccgactgttatccttctctcccgaggaatttccgacgctgaaagcagctggagggcaggacaaggctggcaaagaaaagggcgtcttagatctgtcgtatgggccaggaccaagcctccgccctcagaatgtgacaagctggagggagggcggtgggcgacacataatttctgccacgtctctgagcacctccccaactgagctgggcagcaggaactcgagtacgggagatggagccccctcctcggcatgtaccagcgattctaaggacccctctctccgcccggctcagcctgtccgaaaaggggcttcacagttcatgggaaatgtataccacccacctacataccatgacatgcttcctgcttttatgtgttcgccgaagtcatcagaaaaccagggtacagtggaacgaggctcttttccccttcctcagctccgccttgaacctcgagttccttttagacagttccagatgaatgaccaagacggaaaagaaaacaggctgggattgtctcgcccactccgcccactaaggcagctggtggagcgggcaccacggcccaccattatcaatgcggaaaacctgaagggccttgacgatctggacgccgatgccgatgatggctgggcaggtgggcagagaagcacgggtggtttagacgggcaggaccaaagtccatctgtacttaccagggatggaaaccccctggcaccaccgtgtgttttcccttggcaagatagggatgaagagccggacagggaagcagacctgatgccctccttcctcatttactccctgactagcggttccttcctggccaagccattagcttcttttggtctttagtcttgatcttagagttttgttgttaactttttaaaaattattgatgatgcaaaatttaaacaaaaaagaaaatagctcccaaccactgatcactcaggttcaataagtaccaatgttctgccattcggtttttgtttgttttaatttaatttttttccaagagacagggtctcagctactctgggcatactgc

SEQ ID NO: 299205 - DNA, 871 bp, Homo sapiens
ggcacgagggccgcccgactgccatcgcccggcccggccgcgcccgcggaaccagaccaggcagatcgggagcggtgccgagaaaaatttccttactagatgacatttcatcgcaatgtccgatcgtttggggcaaattaccaagggcaaggatgggaaaagcaagtactcgactctcagcctgtttgataagtataaaggaaaatcagtagacgcgattagatcctcagttattcctagacatggcttacagagtcttgggaaagttgctgcagcccggcgcatgccaccgcctgcaaacctgccaagcttgaagtctgaaaacaaaggaaacgaccccaacatcgtgatagtacccaaggacgggacgggatgggcaaacaagcaggatcagcaagacccaaagagttccagtgcgacggcctctcagccgccggagtcgctgccgcagccgggtttgcagaaatctgtctccaatttgcagaaaccgacacagtcaatcagtcaggagaatacaaattcagtgccaggtggaccaaagtcatgggcacagctgaatggaaagccagtaggacacgaaggtggtttaaggggctcaagccgactgttatccttctctcccgaggaatttccgacgctgaaagcagctggagggcaggacaaggctggcaaagaaaagggcgtcttagatctgtcgtatgggccatgctggcccttacgcgcagccttacctcataaggtctacagtggaggggcgcttctccctcttcaaaaacgtactcacccatggcacatgcaaaattttattgtaaaacggtagccatttgcatttataaagaaagacaccgttctcagcatcctcagaatggcc

SEQ ID NO: 299206 - DNA, 636 bp, Homo sapiens
ggcacgagggccgcccgactgccatcgcccggcccggccgcgcccgcggaaccagaccaggcagatcgggagcggtgccgagaaaaatttccttactagatgacatttcatcgcaatgtccgatcgtttggggcaaattaccaagggcaaggatgggaaaagcaagtactcgactctcagcctgtttgataagtataaaggaaaatcagtagacgcgattagatcctcagttattcctagacatggcttacagagtcttgggaaagttgctgcagcccggcgcatgccaccgcctgcaaacctgccaagcttgaagtctgaaaacaaaggaaacgaccccaacatcgtgatagtacccaaggacgggacgggatgggcaaacaagcaggatcagcaagacccaaagagttccagtgcgacggcctctcagccgccggagtcgctgccgcagccgggtttgcagaaatctgtctccaatttgcagaaaccgacacagtcaatcagtcaggagaatacaaattcagtgccaggtggaccaaagtcatgggcacagctgaatggaaagccagtaggacacgaaggtggtaagtgcgcacgtgagtgtgttgcttgttccgctggggagagggaggtgaa

SEQ ID NO: 299207 - DNA, 370 bp, Homo sapiens
agagcacccttgtgacaagactcccttcaaaagcccacttccaggcaacacggctttcaaggtgtggagctgggaagcagacgactgttgactccatctcacttcctccatgtctaccccgtcttcttgacaggtttaaggggctcaagccgactgttatccttctctcccgaggaatttccgacgctgaaagcagctggagggcaggacaaggctggcaaagaaaagggcgtcttagatctgtcgtatgggccaggaccaagcctccgccctcagagtaagtgactgcagcctctgggcactcgatggagtaacagaacttcctcctctcatctctctgcactcctaaaagggtgctgatgccactggg

SEQ ID NO: 299208 - DNA, 720 bp, Homo sapiens
gcatccggcgcgcggcggttgaattgctgcgcccagcgaggcaaccgcctccgaacgccaggtgggggcgaggcgtctcggagtctcagagacaccaaggcccctgcgacaaggtggctgcagctaggccgggggcgtcaggacgacggagcgggttcgggtcggtgacacgcagacctgagggagctgggcccgccttttccgcccgcgccccaggcccttgcagatcgagatttgcgtcctagagtgggaaaaaagcagaggccagggcgccgattttatttggagagaagcaagcatctttgcctctttggagtaggaaattcagacttgaaaaagtggtgtgtggttgactctgtttctcgccatgtcttctcacaagactttcaccattaagcgattcctggccaagaaacaaaagcaaaatcgtcccatcccccagtggattcagatgaaacctggtagtaaaatcaggtacaactccaaaaggaggcattggagaagaaccaagctgggtctataaggaattgcacatgagatggcacacatatttatgctgtatcaagttcacgatcatcttacgatatcaagctgaaaatgtcaccactacctggacagttgcacatgttttactgggaatatttttttctgtttttctgtatgctctgtgctagtagggtggattcagtaataaatatgtgaaagcttttgtttcaaaaa

SEQ ID NO: 299209 - DNA, 1528 bp, Homo sapiens
  misc_feature (767)..(767): n is a, c, g, or t
gcatccggcgcgcggcggttgaattgctgcgcccagcgaggcaaccgcctccgaacgccaggtgggggcgaggcgtctcggagtctcagagacaccaaggcccctgcgacaaggtggctgcagctaggccgggggcgtcaggacgacggagcgggttcgggtcggtgacacgcagacctgagggagctgggcccgccttttccgcccgcgccccaggcccttgcagatcgagatttgcgtcctagagtgggaaaaaagcagaggccagggcgccgattttatttggagagaagcaagcatctttgcctctttggagtaggaaattcagacttgaaaaagtggtgtgtggttgactctgtttctcgccatgtcttctcacaagactttcaccattaagcgattcctggccaagaaacaaaagcaaaatcgtcccatcccccagtggattcagatgaaacctggtagtaaaatcaggtacaactccaaaaggaggcattggagaagaaccaagctgggtctataaggaattgcacatgagatggcacacatatttatgctgtatcaagttcacgatcatcttacgatatcaagctgaaaatgtcaccactacctggacagttgcacatgttttactgggaatatttttttctgtttttctgtatgctctgtgctagtagggtggattcagtaataaatatgtgaaagcttttgtttcaaaaaaaaaaaaaaaaaaaaaaaaaaaaaaaaaaaaaaaaaaaaaaaaaaanaaaaagaagagaggggcgggcgccctcccaagagagtgcttctctcccgccagcgagggggcgcgccaaggcagtgctgcgcgcgcagctcacaccgcgagttttggatggtgccacagagagggtcgcgcccccactacgggggggagcggctgtatcatcaacacagcacgccaagcgcgacgccgggggccgcgacggcgcctattatatctcccacaaaacgcgcccgggaaccaagaggagagaacaaacacgcgcccgtccaccaagcggaggcacacccatctctgagacgaacaaaacgcacccgccaacaaatagggcaggcaggacagtgtgacgcacacaacagaagggcagccacacacagcaccccgtcccaccaacgcaacagatcaactccacagacgccccccccaacccggcggcacacacacacccccacgccaccaccctccccagacggccgccagcaacatccaagacgccgccaccaacaacccgcacagcccgccactcagagcgcgcgccctgcgcccgcgcgcggcagaaccgaccagaccatccgcgcaccgcaccaccccagcgcgggcgaagccccgcagcactcgccctccagcacgccacacactgacgtctgtcacccacgccgcccccgggagcaccaccggccaaggaccggacaacaaacaccgcccgagctccaccgcacacaccaggcgcgccaccgccgccacgcccacccgcacgcgccgccc

SEQ ID NO: 299210 - DNA, 797 bp, Homo sapiens
gcatccggcgcgcggcggttgaattgctgcgcccagcgaggcaaccgcctccgaacgccaggtgggggcgaggcgtctcggagtctcagagacaccaaggcccctgcgacaaggtggctgcagctaggccgggggcgtcaggacgacggagcgggttcgggtcggtgacacgcagacctgagggagctgggcccgccttttccgcccgcgccccaggcccttgcagatcgagatttgcgtcctagagtgggaaaaaagcagaggccagggcgccgattttatttggagagaagcaagcatctttgcctctttggagtaggaaattcagacttgaaaaagtggtgtgtggttgactctgtttctcgccatgtcttctcacaagactttcaccattaagcgattcctggccaagaaacaaaagcaaaatcgtcccatcccccagtggattcagatgaaacctggtagtaaaatcaggtacaactccaaaaggaggcattggagaagaaccaagctgggtctataaggaattgcacatgagatggcacacatatttatgctgtatcaagttcacgatcatcttacgatatcaagctgaaaatgtcaccactacctggacagttgcacatgttttactgggaatatttttttctgtttttctgtatgctctgtgctagtagggtggattcagtaataaatatgtgaaagcttttgtttcaaaaattgtaaaaatattttattaatattaatgtcttttaatatcgattaaatgatattttcatcttttgggtctctaattt

SEQ ID NO: 299211 - DNA, 1092 bp, Homo sapiens
  misc_feature (767)..(767): n is a, c, g, or t
gcatccggcgcgcggcggttgaattgctgcgcccagcgaggcaaccgcctccgaacgccaggtgggggcgaggcgtctcggagtctcagagacaccaaggcccctgcgacaaggtggctgcagctaggccgggggcgtcaggacgacggagcgggttcgggtcggtgacacgcagacctgagggagctgggcccgccttttccgcccgcgccccaggcccttgcagatcgagatttgcgtcctagagtgggaaaaaagcagaggccagggcgccgattttatttggagagaagcaagcatctttgcctctttggagtaggaaattcagacttgaaaaagtggtgtgtggttgactctgtttctcgccatgtcttctcacaagactttcaccattaagcgattcctggccaagaaacaaaagcaaaatcgtcccatcccccagtggattcagatgaaacctggtagtaaaatcaggtacaactccaaaaggaggcattggagaagaaccaagctgggtctataaggaattgcacatgagatggcacacatatttatgctgtatcaagttcacgatcatcttacgatatcaagctgaaaatgtcaccactacctggacagttgcacatgttttactgggaatatttttttctgtttttctgtatgctctgtgctagtagggtggattcagtaataaatatgtgaaagcttttgtttcaaaaaaaaaaaaaaaaaaaaaaaaaaaaaaaaaaaaaaaaaaaaaaaaaaanaaaaaaaaaaaaaaaaaaaaaaaaaaaaaaaaaaaaaaagggggcacacaacacaaaagaaaaacacacacagggaggggcgacaacaaacaaaacaacacacaaccacagataagcagcagaaaaagagagagagcgacccaaaagacggaggggaataactaaccagacaggcgacgggggggcagaaaagaaaaaaaccacgagagggaaaaaaccacacgcaagcgacagtaccgagcaagaccacacaacaacggcgggggaaacagcagacaaaccacaaaagaaaaaacgcgcagcgaaataacgcgagggcacaagg

SEQ ID NO: 299212 - DNA, 656 bp, Homo sapiens
gcatccggcgcgcggcggttgaattgctgcgcccagcgaggcaaccgcctccgaacgccaggtgggggcgaggcgtctcggagtctcagagacaccaaggcccctgcgacaaggtggctgcagctaggccgggggcgtcaggacgacggagcgggttcgggtcggtgacacgcagacctgagggagctgggcccgccttttccgcccgcgccccaggcccttgcagatcgagatttgcgtcctagagtgggaaaaaagcagaggccagggcgccgtggtgtgtggttgactctgtttctcgccatgtcttctcacaagactttcaccattaagcgattcctggccaagaaacaaaagcaaaatcgtcccatcccccagtggattcagatgaaacctggtagtaaaatcaggtacaactccaaaaggaggcattggagaagaaccaagctgggtctataaggaattgcacatgagatggcacacatatttatgctgtatcaagttcacgatcatcttacgatatcaagctgaaaatgtcaccactacctggacagttgcacatgttttactgggaatatttttttctgtttttctgtatgctctgtgctagtagggtggattcagtaataaatatgtgaaagcttttgtttcaaaaa

SEQ ID NO: 299213 - DNA, 1464 bp, Homo sapiens
  misc_feature (703)..(703): n is a, c, g, or t
gcatccggcgcgcggcggttgaattgctgcgcccagcgaggcaaccgcctccgaacgccaggtgggggcgaggcgtctcggagtctcagagacaccaaggcccctgcgacaaggtggctgcagctaggccgggggcgtcaggacgacggagcgggttcgggtcggtgacacgcagacctgagggagctgggcccgccttttccgcccgcgccccaggcccttgcagatcgagatttgcgtcctagagtgggaaaaaagcagaggccagggcgccgtggtgtgtggttgactctgtttctcgccatgtcttctcacaagactttcaccattaagcgattcctggccaagaaacaaaagcaaaatcgtcccatcccccagtggattcagatgaaacctggtagtaaaatcaggtacaactccaaaaggaggcattggagaagaaccaagctgggtctataaggaattgcacatgagatggcacacatatttatgctgtatcaagttcacgatcatcttacgatatcaagctgaaaatgtcaccactacctggacagttgcacatgttttactgggaatatttttttctgtttttctgtatgctctgtgctagtagggtggattcagtaataaatatgtgaaagcttttgtttcaaaaaaaaaaaaaaaaaaaaaaaaaaaaaaaaaaaaaaaaaaaaaaaaaaanaaaaagaagagaggggcgggcgccctcccaagagagtgcttctctcccgccagcgagggggcgcgccaaggcagtgctgcgcgcgcagctcacaccgcgagttttggatggtgccacagagagggtcgcgcccccactacgggggggagcggctgtatcatcaacacagcacgccaagcgcgacgccgggggccgcgacggcgcctattatatctcccacaaaacgcgcccgggaaccaagaggagagaacaaacacgcgcccgtccaccaagcggaggcacacccatctctgagacgaacaaaacgcacccgccaacaaatagggcaggcaggacagtgtgacgcacacaacagaagggcagccacacacagcaccccgtcccaccaacgcaacagatcaactccacagacgccccccccaacccggcggcacacacacacccccacgccaccaccctccccagacggccgccagcaacatccaagacgccgccaccaacaacccgcacagcccgccactcagagcgcgcgccctgcgcccgcgcgcggcagaaccgaccagaccatccgcgcaccgcaccaccccagcgcgggcgaagccccgcagcactcgccctccagcacgccacacactgacgtctgtcacccacgccgcccccgggagcaccaccggccaaggaccggacaacaaacaccgcccgagctccaccgcacacaccaggcgcgccaccgccgccacgcccacccgcacgcgccgccc

SEQ ID NO: 299214 - DNA, 124 bp, Homo sapiens
cagacctgagggagctgggcccgccttttccgcccgcgccccaggcccttgcagatcgagatttgcgtcctagagtgggaaaaaagcagaggccagggcgccggtaagtaaaggttcctcctca
